United States Patent 11,098,302 (IDENTIFICATION OF POLYNUCLEOTIDES ASSOCIATED WITH A SAMPLE) - sequence listing, part 49

SEQ ID NO: 166864 - DNA, 529 bp, Homo sapiens
  misc_feature: GYAE6OF02HDGFO.26.71.G05.1.454.CMB.1.raw
  modified_base (233)..(233): a, c, t, g, unknown or other
  misc_feature (233)..(233): n is a, c, g, or t
  modified_base (415)..(415): a, c, t, g, unknown or other
  misc_feature (415)..(415): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggcatcttccaagataagaagcggccctcagggatccctgaccgaatttctggctccaactctggaacacagccactctgaccatcagcgggccagccaacgatgaggagactactattgtcaggcgtggganaagtactagttgtagtgtttggcgtagggaccgaggcgtgtaccgtccgtaggtccgagcccgaaggcctcggaccccctcggtacctaccgtcctcgttccccgcccttcccg

SEQ ID NO: 166865 - DNA, 529 bp, Homo sapiens
  misc_feature: GYAE6OF02G8TZE.26.71.G05.1.454.CMB.1.raw
  modified_base (233)..(233): a, c, t, g, unknown or other
  misc_feature (233)..(233): n is a, c, g, or t
  modified_base (319)..(319): a, c, t, g, unknown or other
  misc_feature (319)..(319): n is a, c, g, or t
  modified_base (414)..(414): a, c, t, g, unknown or other
  misc_feature (414)..(414): n is a, c, g, or t
  modified_base (455)..(455): a, c, t, g, unknown or other
  misc_feature (455)..(455): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatcttccaagataagaagcgccctcagggatcccngaccgaatttctggctcaactctggaacacagccactctgaccatcagcggcccagccaacggatgaggagactactattagtcaggcgtggganaagtactagttgtaagtgtttaggcggtagggaccgacggntcggaccgtccgtaggtcgacgacccgaaggcctgaccccctcggtacctacgtcctcgttcccgcccttcccg

SEQ ID NO: 166866 - DNA, 703 bp, Homo sapiens
  misc_feature: GYAE6OF02JZ9YB.26.71.G05.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
tcagagactatactcacgaccggtgctcgatttagtgtcgtcgcaagagagaggggcgtgggcctcaggaagcagcatcggaggtgcctcagccatggcatggatccctctcttcctcggtcgtccttgcttactgcacaggatccgtggccttcgatgagctgattcagccaccctcagtgtccgtgtccccaggaccagacngccacatccacctgcctcggcagacaaatgganatagaaatgactgcctggtatacaggagaccaaggtcccacggttcccctagttttcggtctactcctttaccgaaataacgttaaagaaccgccggtccccttcgaacgggtacctccccgtaggaacccgtaattttccgtcggtaccttacccgaaactccggtaggaaaccaaccgtacggccctaaacgtcccttacggaaccctaagttaccgaccggtaccggggaccccaacggtacccgaaaccggacgtacgggacgggaaactaccgttaaccttaacgttcggtaccgacgggtacggttacggggaagtaacttaacggttagttacgggtacgtttaagggttcgggaacgggtacggtacgacggtctacggaccgttacggtcgtacgtaccggacctacggtccgtaccggccccctagggtacctccgtttaccgcccgttcccccgg

SEQ ID NO: 166867 - DNA, 571 bp, Homo sapiens
  misc_feature: GYAE6OF02HMVSS.26.71.G05.1.454.CMB.1.raw
  modified_base (236)..(236): a, c, t, g, unknown or other
  misc_feature (236)..(236): n is a, c, g, or t
  modified_base (338)..(338): a, c, t, g, unknown or other
  misc_feature (338)..(338): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcgccctgagggatccctgaccgtaatttcgnggcctccaactcgtagggaacacagccactctcgaccatccaggccgggccccagcccgaacggagtggaacgggagacgttactagttcgtacgaggcgtagggagaagttacgtagttgtagttgtttcgggcgggtacggaccgtaggctacggaccggtccgtaggtccgacggcccgaaggccgtccgtcccccgtcggttacccaccgttccgtaccgttacccccg

SEQ ID NO: 166868 - DNA, 562 bp, Homo sapiens
  misc_feature: GYAE6OF02JGFHB.26.71.G05.1.454.CMB.1.raw
  modified_base (451)..(451): a, c, t, g, unknown or other
  misc_feature (451)..(451): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattgggagatagaaatgactgcctggtattaccagtaggccaggccaggtcccctattttcggtacacttcttccaagataaagaacgcggaccctcgagggactcccgtgaaccgtaatttcgtggcctaccaactcgtagggaacacgagtccactctagaccatcgaggccgggcccaggcccaacggatacggagggacactacgtattgtcaggcgtggganatacgtagttgtagtgttggcggtaggaccaggctcgaccgtcgtacggtcgacgcccgaaggtcctccgtccccgtcggtcctaccgtccgtcgttccccgcccttcccg

SEQ ID NO: 166869 - DNA, 672 bp, Homo sapiens
  misc_feature: GYAE6OF02IW75L.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtcgtccgtgtccccaggacagacagccacatcacctgctcgcagacaagtgganatagaatgctgcctgtataccgagacgccaggccagtccccttagtttcggtcattccttaccaagtactaacggtaacgccggtacctcgacgggtacctccgtagacccgttaatttccgtacggtccttaccaacgtcgtacgggaaaccacgcgtaccctacttccgtaacgaccctagtacccgaggcccggggtacccaggtacccgaaaggtcgtagggaacggacgtacgttacttacgttcgtaccggtagggtcggtacgggaataacgtaacgttagttacggttaggttacgggtttacggaccgggtacggtaaccgtggtaccgttacgtacccggtacgtcgggtaccaaccggtaccgtaaccgggtccgttacccggaccccggttcggtaccctaccggttccggttcccttaccccccggg

SEQ ID NO: 166870 - DNA, 597 bp, Homo sapiens
  misc_feature: GYAE6OF02IIGMP.26.71.G05.1.454.CMB.1.raw
  modified_base (237)..(237): a, c, t, g, unknown or other
  misc_feature (237)..(237): n is a, c, g, or t
  modified_base (329)..(329): a, c, t, g, unknown or other
  misc_feature (329)..(329): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaaagttgganatagaaatgctgcctggtattaccagagccaggccagtcccctattttcggcatcttcaagataagagcgcctgaggatcctgaccgattcnggctaccaactcgaggacacagccactctcgaccatcgacgccggggacccacggcccaaacgggactcggagggaacgtacctaacgttatttcggtacgacgggtcgtaggggactaaagtacgttagttagtaggttggtttacgggcggtagggtacccgagggtccgtacggacccggttaccgtacgggtccacggtaccccgaacgggtcccgtacggccccccgttcgggtaccctacgttcccgttcgttacccccccg

SEQ ID NO: 166871 - DNA, 660 bp, Homo sapiens
  misc_feature: GYAE6OF02IRZZ5.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagttggganatagaaatgactgcctggtattaccagacggccaggcctagtcccctaattttcggtcatcttaccaagataagaacgcggccctcgagggactcccgtagaccgtaatttcgcggctaccaactcgtagggaacacgacgaccactctcgaacctatccgaacgggtcccggggaccccaaggaccccgaaacgggtacgtacgggaacggggaacgtaccgttaacgttacgtttacggtacgacgggtacggtacggggaacgtaaacgttaacgttagttacggttaggttcggttttacgggacgggtagggtaccgagggtcctacgggtacccgttccggtaaggtcccacggacccgtaacgggtcccgtaccggtcccccgtaggttacccaccgttcccgtccgttaacccccg

SEQ ID NO: 166872 - DNA, 703 bp, Homo sapiens
  misc_feature: GYAE6OF02HLWHA.26.71.G05.1.454.CMB.1.raw
  modified_base (230)..(230): a, c, t, g, unknown or other
  misc_feature (230)..(230): n is a, c, g, or t
  modified_base (324)..(324): a, c, t, g, unknown or other
  misc_feature (324)..(324): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtataccagagccagccagtcccctatttggcatctccaagataagagcggcctcgagggactccgtgaccgtatttcngcctaccaactcgtacgggaacacgacgccctactctacgaccagtacgaggcccggggaccctaacggacccgaaacgggacgtagggaacggggtaacgaaccgttacgtaagtttacggtccgaacgggtccggtaggggaacgtaaacgttaccgttaagtttaggttacggttagggttttacggggaccgggtaacggggtaacccgtagggtacccgttacggtaacccgggttacccgttaacgggttacccgtaacgggacccccgtaaagggtccccggttacccggtacccccccggtttacggggtacccctaacccggtttacccggtttaccccggtttaccccccctaccccccgtttaccccg

SEQ ID NO: 166873 - DNA, 729 bp, Homo sapiens
  misc_feature: GYAE6OF02GRYEV.26.71.G05.1.454.CMB.1.raw
  modified_base (233)..(233): a, c, t, g, unknown or other
  misc_feature (233)..(233): n is a, c, g, or t
  modified_base (341)..(341): a, c, t, g, unknown or other
  misc_feature (341)..(341): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaatgctgcctggtataccagacggccaggccagtccccttattttggcatcttccaagataagaacgcggaccctcgagggactcccgtagaccgtaatttcgnggtcctacctaactcgtagggaacacacgcccactcgtacgacctataccgacggcccggggacccaacggacccgaaacgggacgtacgggaacgggacgtaacctaccgttaagtttcggtaccgacggggtaccggttaggggaacggttaaacgttacgtttaacggtttagggttacgggtttagggttttacggggtacggggtaacgggggtaaccgtacgggtaccgtaccgggtaacccgggttaccgtaacggggtaccgtaaaccgggtaacccccgtaacggggtcccgttacccgggtcccccccggtttacggggtccctaacccgtttcccgtttaccccgggtttaccccccgtacccccgtttacccccgg

SEQ ID NO: 166874 - DNA, 561 bp, Homo sapiens
  misc_feature: GYAE6OF02GAU0J.26.71.G05.1.454.CMB.1.raw
  modified_base (300)..(300): a, c, t, g, unknown or other
  misc_feature (300)..(300): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagataagaaatgctgcctggtattaccagaggccaggccagtcccctattttggtcatcttccaagntaagaagcggcccttcagggactccccgtgaccgtaatttcctggctcccaacgtcgtagggaacacgtagcccactctgacccatcgacgcgggcccagccaacggntggaggganactactattgcaggcgtggagatactatgtagtgttggcggagggtaccaggtctcggacccgttcgtaggtaccacggcccaacgggcctccgacccccgttcggtaccctacccgtcctaccggttccccgcccttaccccg

SEQ ID NO: 166875 - DNA, 656 bp, Homo sapiens
  misc_feature: GYAE6OF02G3PDI.26.71.G05.1.454.CMB.1.raw
  modified_base (184)..(184): a, c, t, g, unknown or other
  misc_feature (184)..(184): n is a, c, g, or t
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccgttgaaggagtctggtcctgcgctggtggagcccagcagaccctnacgctgacctgctccgtctctggattctcactcaccacgactgaggtgaatgcggcctgggtccgtcacgggccccggaaaggccctggagtcggcttgcactcatttacgtggagtgatcgtacgaagcgtacaacgttccgtctcgtgacggataccggactcacctactccgaaccgacgggacctaccgtaccgaaacggtacccgggtgtaccctttaacaacgttccgaaacccgacgacgtacgtaacgttccctaggtacgaacctaccgaggtaccaacgtaacttacttacgtggttacaccaacctacgtacggtcccgtaggtccggacgttaccgacggaaacggtaaaaacgagtaacttacgtagttacgggttcggggacccttaaggggttaactttttgggacccgtaccggttccctacccgacgtaccccgtacccgaacgtaaccccgggg

SEQ ID NO: 166876 - DNA, 541 bp, Homo sapiens
  misc_feature: GYAE6OF02GL1TI.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtcccgtgtccccaggacagacagccaccatcacctgctcggcagacaaattgggagatagaaatgctgcctggtattacagaggccaggccagtcccctattttggtcatcttaccaagataagacgcggccctcaggactccctgaccgaatttcgtggctccaactctgggaacacgagcccactcacgaccatccgaggaccgggccccaggcccgaaacggataggaacgggagacgttaactagttgtcgaggcgtgggagaatacgtagttagtagttggttggcgggaggacgaggcgtgaccgtcgtacggtcacgcccgaggctccgccccgtcgccactcctcgtccccg

SEQ ID NO: 166877 - DNA, 585 bp, Homo sapiens
  misc_feature: GYAE6OF02HIJG6.26.71.G05.1.454.CMB.1.raw
  modified_base (238)..(238): a, c, t, g, unknown or other
  misc_feature (238)..(238): n is a, c, g, or t
  modified_base (449)..(449): a, c, t, g, unknown or other
  misc_feature (449)..(449): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaagttggganatagaaatgctgcctggtattaccagaggcaggcagtcccctatttgtcatctccaagataagaacgcggccctacgagggactccctagaccgaatttccgtggcctaccaactcgtagggaacacagccactctgaccatccaggccgggacccagaccgaacggatggaagggacgacttaacgtattcgtacacgggtcgtgggaanaattacgtagttgtaggttcggtttggacgggtaggtaccgaggtctcggaccgttccgtaagggtccaacggtcccgaaggtccgtccggtaccccccgtacggttccctaaccgttccgttaccgtaccccccg

SEQ ID NO: 166878 - DNA, 511 bp, Homo sapiens
  misc_feature: GYAE6OF02GV12E.26.71.G05.1.454.CMB.1.raw
  modified_base (233)..(233): a, c, t, g, unknown or other
  misc_feature (233)..(233): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatcttccaagataagaagcggccctcagggactccctagaccgaatttctggctccaactctgggaacacgacgccactctgaccatcagcgggcccagccaacgntgagganactactatcgtcaggngtggganatacgtattgtagttgttggcggaggtaccaggctgaccgtcgtagtcgacgccaaggctcgcccctcgtcacgtctcgtcccacccgtcc

SEQ ID NO: 166879 - DNA, 539 bp, Homo sapiens
  misc_feature: GYAE6OF02FZJPO.26.71.G05.1.454.CMB.1.raw
  modified_base (174)..(174): a, c, t, g, unknown or other
  misc_feature (174)..(174): n is a, c, g, or t
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcacctgctcggcagacaaattggganatagaaatgctgcctggtattaccagaggccaggccagtcccctatttggtcatcttccaagataagaagcggccctcagggatccccgtgaccgaatttctggctccaactctaggaacacagccactctcgaccatcgacgcgggcccagccaaggatggagggagactactagttgtcaggcgtgggagaatactatgtagtgtttggcggtagggacaggtcgtgaccgttctacggtacgacggacccaaggcctacggccccctcggtcccgtacttcgtccgttccccgcccttacccg

SEQ ID NO: 166880 - DNA, 686 bp, Homo sapiens
  misc_feature: GYAE6OF02ISBLL.26.71.G05.1.454.CMB.1.raw
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcgcagacaattggagatagaacngctgctggtataccagngccagccagtccctattttcggctatcttacaagataagaacgcgtcctacgagggtactcccgtagaccgtaactttcgaggacctacaactcgtaggaacctacacgaccactctacgacctagtcgacggccgggacccacgaccgtaaacggagcggaacgggacgtaactacgttagttcgtcgacggggtacggtagggtaactaagttaacgtaggttacggttaagggttcggttttagggaccggggtacgggtaaccgtacggtacgttaccgggaacccgtttacccgtacgggttacccggaacggttaccccggtaaaggggtcccccttaccggggtaccccccgtttacgggaccccgttaacccgtttcccggttttaccccgggttaccccccggttcccccggttaaccccgg

SEQ ID NO: 166881 - DNA, 713 bp, Homo sapiens
  misc_feature: GYAE6OF02GYLRZ.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaagttggganatagaaatgctgccgtggtataccagacggccaggccacgtccccttattttcggtacacttcttaccaagtactaaggaacgccggccctcgaggtactccctgaccgtaattctcggcctacctaactcgtagggaacacgacgcctactcctacgacctactacgacggcccggggaccccacggacccgaaacgggactagggaacggggaacgtaaccgttaaccgttagttacggtaccgtaacggggtacgggtaacggggtaacgtaaacgttaacttacggtttaggtttaagggtttgggtttacggggaacgggtacgggtaacccgtagggtccgtaccgggtacccggttaccggttaacgggtacccgaacgggtacccccgtaaacggggcccttaccccggtacccccggttcccgggttacccggtacccgtttacccggttccccggtttacccccccgg

SEQ ID NO: 166882 - DNA, 815 bp, Homo sapiens
  misc_feature: GYAE6OF02GKI76.26.71.G05.1.454.CMB.1.raw
  modified_base (176)..(176): a, c, t, g, unknown or other
  misc_feature (176)..(176): n is a, c, g, or t
  modified_base (236)..(236): a, c, t, g, unknown or other
  misc_feature (236)..(236): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctnagtcgtccgtgtccccaggacagacacgccaccatcacctgctcggcagacaattggganatagaatgactgctggtaattaccagaggccaggccacgttccccttagttttcggacctacgttccttacccgaaagtaacgtaaacggaacggtcccgggtaccccttacggaacgggggtaccttacccccgtacggtaaccccgttaaacttttccggtacgggttaccccttacccgtaaaccgttccggttaaacggggaacccaacggtaacgtacccctaactccgttacgaaccctacgtccggaacgggcccgggaccccaagggccccgaaacgggagtacgggaacgggacgtaacttacgttagttcggtaccgtagggtaccgggtaggggaaacgtaaacgttacgttaaggttaggttacgggtttcggttttaggggccggggttaaacgggggtaccctaaagggggttacccttacggggttaaccccggttcccgttaacggggtacccgaaccgggtacccggtaaacgggtccccgttacccggtacccccccggttcggttaacccgttcccgttacccggttacccccggtttccccccgacccgtttaccccgg

SEQ ID NO: 166883 - DNA, 306 bp, Homo sapiens
  misc_feature: GYAE6OF02GUM7O.26.71.G05.1.454.CMB.1.raw
  modified_base (301)..(306): a, c, t, g, unknown or other
  misc_feature (301)..(306): n is a, c, g, or t
tcagagactatactcacgaccggtgctcgatttagtgtcgtcgcaagagagagggggccctcagggatccctgaccgaatttctggctccaactctgggaacacagccactctgaccatcagcggggcccagccaacggatgagggagactactattgtcaggcgtgggagaatactattgtagtgtttggcggagggaccaggctgaccgtcctaggtcagcccaaggctcgccccctcggtcactctcgttcccaccctcctcagtatagtctctgagcgggctggcaaggcgcatagnnnnnn

SEQ ID NO: 166884 - DNA, 866 bp, Homo sapiens
  misc_feature: GYAE6OF02IWIPW.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacacgccaccatcacctgctcggcagacaagtgganatagaatgctgcctggtacttaccagaggccaggccacgtccccttagttttcggtctacgttcttacccgaaagtacgttaaacggaacgccgggtacccctacgacgggtacttccccgtagtaaccccgtaaagttttccgtacggggtacccttaacccgtaaaccgttaccgtaacgggggtaaaaccaacgtaaaccggtaccccgtaaaccgttcccgttaacgaaacccccgtaacgttacccggtaccggggtaccccgggggggaacccccgtaaaccggacccccgggaaaaccgggtaacgttacgggggtaaacgggggtaaaccggtaaacccgtttaaacccggttacgtttacgggtaacccgtaacggggggttccggttaagggggaacgttaaaacgttacgttttaacggttagggttttaacgggtttcggtttttccggggggaacggggttacgggggtaaacccgtaaccggggttacgttacccgggtacccggttacccggttacgggttacccgaccgggtaaccccgtaacggggtcccgtccccgtaccccggtcggttaccctaccgttcccgttcccggttaccccctacccgttaccccg

SEQ ID NO: 166885 - DNA, 576 bp, Homo sapiens
  misc_feature: GYAE6OF02JD42H.26.71.G05.1.454.CMB.1.raw
  modified_base (237)..(237): a, c, t, g, unknown or other
  misc_feature (237)..(237): n is a, c, g, or t
  modified_base (400)..(400): a, c, t, g, unknown or other
  misc_feature (400)..(400): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaaattggganatagaaatgctgcctggtattaccagaggccaggccagtcccctatttggtcatcttccaagataagagcggcctcgagggactccgtgaccgtaattctggctaccaactctagggaacacacgccactctcgaccatcacggccgggacccagcccaaggngtaggagggacgtactaacgtagttacgtcagggtcgtagggaactaagtacttagttgttagttggtttacgggacgggtagggaccgaggtccgtacggaccgttaccgtaacggtccacggacccgtaaggtccgtccggtccccgtcggtcacccgttctccgttacccccc

SEQ ID NO: 166886 - DNA, 664 bp, Homo sapiens
  misc_feature: GYAE6OF02FY13N.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggactccctgaccgtaatttctcggctccaactcgtacgggaacacagcccactctagaccatccgaggtccgggacccaggacccgaaacgggacttagggaacggggaacgtaaccgttaacgttagtttcggtacgagggaccggttaggggaacgtaaacgttacttaagttggttaacggtttggttttgggaccggggtaacgggacccgtagggtccgttacgggacccgttaccgtaccgggtaccgaacggtaccccggaacgggtcccgttcccggtaccccccgttcgggttaccctaccgtttaccccgttcccgtttaccccccgtaccccgttccccg

SEQ ID NO: 166887 - DNA, 525 bp, Homo sapiens
  misc_feature: GYAE6OF02FG5DJ.26.71.G05.1.454.CMB.1.raw
  modified_base (240)..(240): a, c, t, g, unknown or other
  misc_feature (240)..(240): n is a, c, g, or t
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
  modified_base (499)..(499): a, c, t, g, unknown or other
  misc_feature (499)..(499): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtcccgtgtccccaggaccagacagcccaccatcaccctgctcggcagacaaattggganatagaaatgctgcctggtattaccagaggccaggccagtcccctattttggcatcttccaagataagaagcggccctcagggatccctgaccgaatttcnggctccaactctgggaacacagccactcngaccatcagcgggccccagcccaaacggctggagggagactactagttgtaccagggtcgtggggaagaatactattgttagtgtttggcggagggccgaggctgaccgtcctaggtcacgcccaaggcncgcccctcggcacctctcgttccccg

SEQ ID NO: 166888 - DNA, 694 bp, Homo sapiens
  misc_feature: GYAE6OF02F5SCI.26.71.G05.1.454.CMB.1.raw
  modified_base (234)..(234): a, c, t, g, unknown or other
  misc_feature (234)..(234): n is a, c, g, or t
  modified_base (443)..(443): a, c, t, g, unknown or other
  misc_feature (443)..(443): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagacggccaggccacgttccccttattttcggtcctacttccttaccaaagaactaaaggaacggccggaccctacgacgggtactccccgtagtaaccgtaagtttcctggtacctacctaactcgtacggaacacacgccactctacgaccatcgacggccgggacccacgtaccgaacggagnggaacgggactaactacgttacgttcgtacggaggtaccggtagggaactaacgttacgttagttaggttaggtttggtttacgggacggggtaacgggtacccgtagggtaccgttacgggacccggttacgtaacgggtaccgtaaccgggaacccgtaaccggggtcccgttaccccggtcccccggttccgggtacccttaacccggttcccgtttaccccggttaccccctaccccgtttaccccg

SEQ ID NO: 166889 - DNA, 696 bp, Homo sapiens
  misc_feature: GYAE6OF02GVU3J.26.71.G05.1.454.CMB.1.raw
  modified_base (348)..(348): a, c, t, g, unknown or other
  misc_feature (348)..(348): n is a, c, g, or t
tcagagactatactcacgaccggtgctcgatttagtgtcgtcgcaagagagaggggcgtgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgcctacggcagacaaagttgggagatagaatgctgcgtgtataccagacgccgagccagtccccttagtttcgtctagtccttacaagactaaagaacgccgcctagaggtactccgtagaaccgtattccnggtcctacctaactcgtacggaactacgacgccactcctacgaccactctacggccgggacccgaacgacccgaacggacgtaggacgggaagtaccgtaaacgttacgttacgtacggacgggtacggtacggggaagtaaacgtaacgttaacgtttgttaacgggtttagggtttacggggtacggggtacgggaaccggtaagggtaccggttaccggtacccgggtttaacccggttaacgggtaaccggtaaccggtaaccccgggtaaccggtaccggtacccccggtaccccggttcccgttacccggtacccgttcccggttacccggtttccccccgg

SEQ ID NO: 166890 - DNA, 551 bp, Homo sapiens
  misc_feature: GYAE6OF02GFT1G.26.71.G05.1.454.CMB.1.raw
  modified_base (235)..(235): a, c, t, g, unknown or other
  misc_feature (235)..(235): n is a, c, g, or t
  modified_base (323)..(323): a, c, t, g, unknown or other
  misc_feature (323)..(323): n is a, c, g, or t
  modified_base (400)..(400): a, c, t, g, unknown or other
  misc_feature (400)..(400): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtattaccagaggcccaggcccagtcccctattttcggtcattcttccaagataagaagcggccctcagggntcccctgaccgaatttctggctccaactctcgggaacacagccactctgaccatcaggcgggcccagccaacggacnggagggagactactagttgtcaggcgtgggagtaatacttagtgtagtgtttggcggtagggccaggcgtcgaccgtcgtaggtccgagacccgtaggccgtcggtcccccgtcggtcctaccgttccgtaccgttccccgcccgttcccg

SEQ ID NO: 166891 - DNA, 645 bp, Homo sapiens
  misc_feature: GYAE6OF02GDVP1.26.71.G05.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtattaccagaggccaggccagtcccctattttggcatcttccaagataagagcgcctnaggntcctgacgtattctgctccaactcgtacggaacacgacgccactctacgacctatcgacggccggggaccccaggacccgaaacgggactacgggaacgggacgtaaccgttaacgttagttcggtaccgacggggtcggtaggggaaacgtaacgttaacgttagtttaggttaggtttgggtttagggaccgggtacgggaaccgagggtccgttacggtacccggttaccggtaacgggttccaaccggtacccgtaacgggtcccgttacccggccccccgttacgggtcccctaaccgtttcccgttacccgtttcccccccgg

SEQ ID NO: 166892 - DNA, 704 bp, Homo sapiens
  misc_feature: GYAE6OF02JTQPO.26.71.G05.1.454.CMB.1.raw
  modified_base (175)..(175): a, c, t, g, unknown or other
  misc_feature (175)..(175): n is a, c, g, or t
  modified_base (236)..(236): a, c, t, g, unknown or other
  misc_feature (236)..(236): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatccacctgcctcggcagacaagttggganatagaatgctgcctaggtattaccagacggccaggcctacgtccccttaatttcggcacttccttaccaagtaataagacgccggccctaggacgggtactccccgtaggaaccgtaagtttccgtcggtacctacccgaattccgtagggaaaccacgtaccgacctaacgtctaccggaccctaacgtcgaacggcccggggacccacggtaaccccgaacgggtagtacggaacggggaacgtaaccgtaacgttagttacggtacgtagggtaccggtagggtaacgtaacgttaacgttagttacgggtagttacgggtttagggacggggtaacgggccgtaggtacgtacggtacccgttaccggtaggtaccggaaccgtacccggtaaggtcccggttaccgccccggttccggtaccgtaacccgttccggtacccgtttcccccgaccgttaccccg

SEQ ID NO: 166893 - DNA, 696 bp, Homo sapiens
  misc_feature: GYAE6OF02H4XTG.26.71.G05.1.454.CMB.1.raw
  modified_base (230)..(230): a, c, t, g, unknown or other
  misc_feature (230)..(230): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaaatgctgcctggtattaccagaggccaggccagttccccttagtttcggtcattcttaccaagataagaacgccggccctcgagggactcccgtgaaccgtaattttcgtcggtacctaccaaactccgttagggaaaccacgacgacccacttctacgaccaactccgacggccggggacccaacggacccgaaacgggtagtacgggaacggggaacgtaccgttaacgttaacgtttacggtacgaacgggtccgggtaggggaaagtaaacgttaacgttaagttaggttaaggtttgggttttaggggacgggtacggggaaccgtagggtaccgtcgggtacccggttaccgtaacgggtccgaacggtaccccgtaacgggtcccgtacccggtccccccggttacggtcccgtaacccgttcccgttaccgttcccccgtaccccgttacccg

SEQ ID NO: 166894 - DNA, 674 bp, Homo sapiens
  misc_feature: GYAE6OF02JJV8V.26.71.G05.1.454.CMB.1.raw
  modified_base (148)..(148): a, c, t, g, unknown or other
  misc_feature (148)..(148): n is a, c, g, or t
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggngtctggtcctgcgcgtggtggacgccccacgcagacccctcacgctgacctgcctcgtctcgtgtattcncactccaccacgacgtgaggtgaatggtcgtccgtcggtccgtcgacggacccccggaaggtcccgtgagtggcttgcacttcatttacgnggatgatcgtagaagcggtacacgtccgtctctagtagaacgtcgactactaccactacgaaccgaacgggacctaaccgtaccgaaaacggtaccggtacggtaccgttaacgtaacgtacgaaccgtacaaacgtactacgtacgttacgtaacggtacgaacgaaccggtacaacgttaaacgttaagttaaccgttcgtaacgcgttaacgaccctaacgttaccgtacggtaccgaccgtaccggtaacgaaacggtaaaagtaaagtaacagttaacgtacggtaacgggtaaggtaacgttaggttacgtaccgttacgtacccgtaccctacgaccccgtacgaacccgtaacccgg

SEQ ID NO: 166895 - DNA, 581 bp, Homo sapiens
  misc_feature: GYAE6OF02IAYTB.26.71.G05.1.454.CMB.1.raw
  modified_base (230)..(230): a, c, t, g, unknown or other
  misc_feature (230)..(230): n is a, c, g, or t
  modified_base (362)..(362): a, c, t, g, unknown or other
  misc_feature (362)..(362): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattacagaggccaggccagtccccttattttcggtctattccttccaagataagaagccggccctcagggactccctgaccgtaatttctcggctccaactctagggaacacgngccactctgaccatcacggccggggcccacgccgaacggatcggaagggacgactaactattggtacgaggcggtagggagaagtacttagtttagtaggttgtttgggcggtagggtaccgaggaccgttcggtaccggtccgtagggtccgacggacccgagggcccgtcgtcccccgtcggtccctaccgttccgttccgtccccgtccttccccg

SEQ ID NO: 166896 - DNA, 654 bp, Homo sapiens
  misc_feature: GYAE6OF02HBYSL.26.71.G05.1.454.CMB.1.raw
  modified_base (237)..(237): a, c, t, g, unknown or other
  misc_feature (237)..(237): n is a, c, g, or t
  modified_base (349)..(349): a, c, t, g, unknown or other
  misc_feature (349)..(349): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaaattggganatagaaatgctgcctggtattaccagaggccaggccagtcccctagttttcggtctatccttccaagtataaagaacgccggccctcgacggggactcctgaccgtaattcncggtctccaactcgtacgggaacacgacgccactctacgaccatccgacggccggggaccccaggacccgaacgggacgtagggaacggggtacgtaaccgttaacgttacgttcggtaccgagggtcggtagggagtaaacgttacgttagtttaggttagttgggtttacgggacgggtaacgggaccgtagggtccgtacggtaacccggttaccgttaacgggtaccgtaaccgggaccccgtaagggcccgttaccggcccccggttacggtccctaccgttccgtcccgttaccccccg

SEQ ID NO: 166897 - DNA, 509 bp, Homo sapiens
  misc_feature: GYAE6OF02FFF1P.26.71.G05.1.454.CMB.1.raw
  modified_base (177)..(177): a, c, t, g, unknown or other
  misc_feature (177)..(177): n is a, c, g, or t
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (493)..(493): a, c, t, g, unknown or other
  misc_feature (493)..(493): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagcccaccatcacctgctcggcagacaaattgggagatagaaatgctgcctggtattaccagaggccaggccagtcccctattttggcatcttccaagataagaagcggccctnaggatccctgccaattcngctccactctggaacacagccactcngaccatcagcgggcccagcccaacggatgaggganactactnttgacaggcgtgggagaatagtattgtagtgtttgggcgtaggccaggctgaccgtcgtaagtcacgacccaggcctcggtcccctggtccnccgtcgttctaccccc

SEQ ID NO: 166898 - DNA, 658 bp, Homo sapiens
  misc_feature: GYAE6OF02HITD2.26.71.G05.1.454.CMB.1.raw
  modified_base (236)..(236): a, c, t, g, unknown or other
  misc_feature (236)..(236): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccacatcacctgctcggcagacaaagtggganatagaatgctgctgtataccagagccaggccagtcccctatttggtcatcttaccaagataagacgcggccctagaggactccgtagaccgtaatttcgngtcctaccaacgtcgtacggaacacacgcctactctacgaccatccgacggccgggacccacggacccgaaacgggacgtacgggaacgggtacgtaacgttaacgttagttcgtaccgtagggtacggtagggtaacgtaaacgttaaccgttagtttagggttaggtttacgggtttacggggaacgggtacgggaaccgtacgggtccggttacggtaccggttccggtaacggtaccggaaccggacccgtaacggtcccgttacccggtaccccccgttcgggttccctaccggttcccgttacccggttccccccg

SEQ ID NO: 166899 - DNA, 641 bp, Homo sapiens
  misc_feature: GYAE6OF02F8BBN.26.71.G05.1.454.CMB.1.raw
  modified_base (337)..(337): a, c, t, g, unknown or other
  misc_feature (337)..(337): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagataagaagcgccctcagggactccctagaccgaatttcnggctccaactctaggaacacacgccactctgaccatcacggcggggcccacgaccgaaacggatcggaagggacgaaccttaactagtttacggtaccgaagggtcggtaggggaagaaattaaccgttaagtttacggttaaggttgggttttacggggaccgggtaaggggtaacccgacggggtccgttacggaaccccggttaccgttaagggtacccgaacggtaccccgtaaacgggtcccttaccggtccccccgttaccgggtacccctaccgtttccctccggtttacccccccg

SEQ ID NO: 166900 - DNA, 707 bp, Homo sapiens
  misc_feature: GYAE6OF02FM7I6.26.71.G05.1.454.CMB.1.raw
  modified_base (238)..(238): a, c, t, g, unknown or other
  misc_feature (238)..(238): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatcccgtggccttcgatgagctgattcagccaccctcagtgtccgtgtccccaggaccagacagccaccatcacctgctcggcagacaaattggganatagaaatgctgcctggtattaccagaggcaggtccagtcccctagttttgcacttcttaccaagataagaagcggccctcgaggactccngacgaatttcnggcctcaactcgtggaaacacgacgaccactcgtagaccatcgaggccggggacccacgacccgtaaacgggagtcggaacgggagtaaccgttaactagttcggtacgtaagggacggttaggggaaacgtaacgtaacgtttaggtttaggttaaggtttaggggttttacggggaccgggggtaaaggggtaacccggtaacgggtcccggttacgggtaccccggtttacccgggttaacggggttacccaacccggggtaccccgttaaaaccggggtcccccgtttaccccgggaccccccccggttttacgggtacccctaaccccgggtttcccgtttacccccggtttccccccccgg

SEQ ID NO: 166901 - DNA, 661 bp, Homo sapiens
  misc_feature: GYAE6OF02GNKGD.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgactgcctggtattaccagacggcaggccacgtcccctatttcggtcatcttccaagataagagcggccctcgagggactcccgtgaccgtaatttcgtggtcctaccaactcgtacgggaacaccgacgcccactcctcgaccatccgaggcccggggccccaggaccccgaacggacgtagggaacggggactaaccgttaacgttacgttcggtacgagggtccgggtagggtaacgtaacgttaaccgttaggtttacgttagggttacggttttacgggacggggtaacggaccggacgggtaccgtacggtacccggttaccggtaacggtacccgacggtaccccgaacgggtccgtacccggtcccccgttaccggtaccctaccgttcccgtccgtttaacccccccg

SEQ ID NO: 166902 - DNA, 527 bp, Homo sapiens
  misc_feature: GYAE6OF02F99XR.26.71.G05.1.454.CMB.1.raw
  modified_base (328)..(328): a, c, t, g, unknown or other
  misc_feature (328)..(328): n is a, c, g, or t
  modified_base (518)..(518): a, c, t, g, unknown or other
  misc_feature (518)..(518): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggagataagaaatgctgcctggtattaccagagccaggccagtccctatttggcatctccaagataagaagcgcctgaggatcctgaccgtaattcngctaccaatcgtggaacactacgccatctagacctatcagccgggaccacgccgaaaggactaggaggacgacttaactattcgtacgacggtggtagggataaagtacttagttgtagtggtttgacggaggaccgagcgtacgacgtcgaaggtcacgcctaggctacgccccgtgtaccacgttccncgttacccc

SEQ ID NO: 166903 - DNA, 607 bp, Homo sapiens
  misc_feature: GYAE6OF02GIGFB.26.71.G05.1.454.CMB.1.raw
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaatgctgcctggtattaccagaggccaggccagtcccctatttggtcatctccaagataagagcggccctnagggactccctagaccgaatttctggctaccactcgtaggaacacacgaccactcgtacgacccatccgacggccggggcccacggacccgaaacgggagtaggaacggggactaacgtacgtattcgtacgtaggcggtagggaagtaattacgttagttacgttaggttggtttacgggacgggtagggtaccgtaggcgtacggacccgttcgtacggtccgaacggtacccgaacggtcctaccggccccgttcggtacctccgttccgttcccggttcccgtacccgttcccg

SEQ ID NO: 166904 - DNA, 704 bp, Homo sapiens
  misc_feature: GYAE6OF02FGGE0.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagttggganatagaaatgctgcctggtacttaccagacggccaggccacgttcccctattttggtctattccttaccaaagtataaggaacgccggccctacgacgggactcccgtgaccgtaatttcgacggtccttaccaactcgtacgggaaccaccgacgccctacctctacgaccacgtcgacggtcccggggaccccacgacccgaaacgggagtacgggaacgggacgtaccttaacgtacgtttcggtacgacgggtaccggtaggggaaactaaacgttacgtttaagtttaggtttaacgggtttagggttttacggggaccgggtaacgggtaccgaacggtaccgtacggtaacccggttaccggtaacggggttcccaaccggtaccccggtaaggtccccgttacccggtacccccccgttaccgggtacctacccgtttccgttccccggtttaaccccccc

SEQ ID NO: 166905 - DNA, 701 bp, Homo sapiens
  misc_feature: GYAE6OF02F2M1D.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaagttgggagatagaatgctgcctggtattaccagaggccaggccacgttccccttagttttcggtactattccttaccaaagtaataaaggaacgccggaccctacgagggtactcccgtagaaccgtaatttcgtggcctaccaactcgtaggaacacacgccactctacgaccatcgacggccgggacccacggacccgaaacgggtactaggggaacggggaacgtaaccgttaaccgttagttacggtaccgtacggggtccggttaggggaaacgtaaagtttaaccgtttaagttagggtttaggtttaggggttttacggggacgggggtaacgggtaccgtaagggtccgttacgggaccccggttaccgtacgggtaccgaaccggtaacccggaacgggttcccgtacccggtacccccggttcggtaccgtacccgttccgtcccgttaccccgtaccccttcccgg

SEQ ID NO: 166906 - DNA, 674 bp, Homo sapiens
  misc_feature: GYAE6OF02GVSZR.26.71.G05.1.454.CMB.1.raw
  modified_base (231)..(231): a, c, t, g, unknown or other
  misc_feature (231)..(231): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaattggganatagaaatgctgcctggtattaccagacggccaggccagtccccttatttggtcatcttccaagataagagcgcctcgaggctccngaccgattcnggcctcactcgtacggaacacacgccctactcctacgaccctagtccgaggccggggacccacgacccgaaacggacgtaggaacggggaacgtaaccgtaacgttaagtttacggtaccgtaagggtccgggttaggggaacgtaaagttaaccgttaagtttagggtttaagggtttgggttttacggggccggggttaaacggggtacccggtaaggtaccgttacggtacccggttaccgtaagggttacccgaacgggaccccgtaaaggggcccgttacccggtccccccgttcggtacccgtaccgtttcccgtccggtttccccccgtcccgttccccg

SEQ ID NO: 166907 - DNA, 688 bp, Homo sapiens
  misc_feature: GYAE6OF02HBWLV.26.71.G05.1.454.CMB.1.raw
  modified_base (237)..(237): a, c, t, g, unknown or other
  misc_feature (237)..(237): n is a, c, g, or t
  modified_base (331)..(331): a, c, t, g, unknown or other
  misc_feature (331)..(331): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtataccagaggccaggccacgttcccctattttcggtacatctccaagataagaacgcggaccctgaggactcccgngaccgtattctgtcctacctaactcgtaggaacaccacgcccactctacgaccagtccgacggcccgggcccacggaccgaaacgggactagggaacgggacgaaccgttaacgttaagttcggaccggtaacgggtcggttaggggaacgtaacgttaacgtttaacgttttggttaacggtttggtttacggggtaacggggaacggggtaaccgaggggtacctacgggtaaccccggttaccggtaaccgggttaccgaacccggtaccccgggtaaccgggtacccgttacccgggtaccccccggttccggtacccctacccggtttcccgtacccggtttacccccccgg

SEQ ID NO: 166908 - DNA, 727 bp, Homo sapiens
  misc_feature: GYAE6OF02H3FGQ.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtcgtccgtgtccccaggacagacagccacatcacctgctcggcagacaaagttggganatagaatgctgcctggtattaccagacggccaggccacgtccccttattttcggtcattccttacaagataagaagtcggaccctcgacgggtactcccgtcgaaccgtaatttccgtacgggtccttaccaaacgttccgttaacgggaaaccaaccgacggtaccctaacttaccgttacggaaccctagttacccgaacgggcccggggaccccgaacgaccccggaaacgggtacgtacgggaaacgggacgtaaccttaacgttaagttcgtacgagggtccgtaagggaagtaacttacgtagttacggttaaggtttgggtttacgggacggggtaacgggtaccggtaacgggtccgtcggtaaccccgttcggttaacgggtcccgtaaggccccggtaaaggcccgttcccggcccccgttccgggttacccctaacccgtttcccgtttacccgggttcccccgtccccgtttaccccgg

SEQ ID NO: 166909 - DNA, 790 bp, Homo sapiens
  misc_feature: GYAE6OF02GKM9G.26.71.G05.1.454.CMB.1.raw
  modified_base (239)..(239): a, c, t, g, unknown or other
  misc_feature (239)..(239): n is a, c, g, or t
tcagagactatactcacgaccggtgctcgatttagtgtcgtcgcaagagagagggggctgggcctcgaggaagcagcatcggaggtgcctcagccatggcatggatccctctcttcctcggcgtccttgcttactgcacaggatccgtggccttcgatgagctgattcagccaccctcagtgtccgtcgtccccaggaccagacagccaccatcacctgctcggcagacaaagtggganatagaaatgctgcctaggtacttaccgagaggccacggcctacgtccccttagttttcggtctacgtccttaccaaagtacgttaaagaaacggcccggtaccccttacgaacggggtaccttaccccgtaggtaacccgtaacgttttaccgtcgggtacccttacccgtaaacgtttccgtaggggaaaccctacgaccgtaccctacgtcctaacggacccagtaccggtaccggacccgggggacccctaacggaccccggtaaacgggtaccgtaacgggaacgggtaacgtaacccgttaagttaacgtttacgggaccgtaacggggtccgggtagggaaacgttaacgttacgttaacggtttggtaacggtttggttacggggtaccggtaacgggtaccgtacgggcccgtttacgggtacccgtaacccggtttaacgggtacctaaccgggtccccggtaaacgggtccccgttacccggtccccccggtttaaccggtaccccgttaacctttcccgggttcccgtttaacccccccg

SEQ ID NO: 166910 - DNA, 658 bp, Homo sapiens
  misc_feature: GYAE6OF02JVT27.26.71.G05.1.454.CMB.1.raw
  modified_base (206)..(206): a, c, t, g, unknown or other
  misc_feature (206)..(206): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtcccccaggacagacagccaccatcacctgctcggcagacaaatggganatagaatgctgcctggtattaccagaggccaggccagtccccttatttcggtcatcttccaagataagaagccggccctcgagggactccccgtagaaccgtaatttccgtggcctaccaactcgtacgggaacacacgccactctagaccataccgacggccggggacccacgacccgaaacggagtacggaagggacgtaacgtaactagtttacgacgagggtccggtagggaaagtaacgttaacttaacgtttaggttaacggttgggttttacgggacgggaacgggtaccgtagggccgtacggtacccggttccgtaacggtccgaccgacccgaaacggtcccgtaccgtcccccgtcggtaccctaccgtccgttcccgttccccctaccctcctaccgtaacgtacttaccgtccttaccgtgacggtccggtcgtacggg

SEQ ID NO: 166911 - DNA, 678 bp, Homo sapiens
  misc_feature: GYAE6OF02JEJ7A.26.71.G05.1.454.CMB.1.raw
  modified_base (234)..(234): a, c, t, g, unknown or other
  misc_feature (234)..(234): n is a, c, g, or t
  modified_base (430)..(430): a, c, t, g, unknown or other
  misc_feature (430)..(430): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccacatcacctgctcggcagacaagttgganatagaatgctgcctgtactaccagagaccagcctacgtccccttatttcggtacacgttcctacaagtagtaagaacgccgcctacgaggactccgtagtaccgtatttcgcgcctacctaacgtctacgggacacgaaccgtccactcacgacctatcggacggcccgggtaccccaggaaccccgaagggtacncgggtaaaggacgtaacctacgttagttacgcggtacgggtaccgggtagggtaactaaacgttaacgttagttacggtttaggttacggggtttgggaccggggtaccgggtaacgtacgggtaccgttaccggaccgttcggaaccgggtaccgaaccggacccgtagggtccctacccggtaccccccggttcggttaccctacccgttcccgtttacccccggttcccctaccccgttacccgg

SEQ ID NO: 166912 - DNA, 767 bp, Homo sapiens
  misc_feature: GYAE6OF02F2ZEG.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggagatagaatgctgcctggtacttaccagaggccaggccacgtccccttatttcggtcactcttaccaagtataaagaagccggcccctacgaggggtacttccccgtacggtaacccgtaaacttttccgtcggtaccctacccgtaaaccttccgttacggggaaaaccacgtacggaccccaaccttcccgtacgaacccgtacgtacccgtaaccgggaccccgggggaccccaaccggaccccggtaaaaccgggaacgttacgggaacggggtaaaccggaaccgttaaacgttaacgtttcgggttaaccgtacggggtaccggttaagggggaacgttaaacgttaacgtttaaggtttaggtttaaggtttcgggttttacggggaccgggtaacgggaacccgtagggtccgttacgggtacccggttaccggttagggtaacccgaacggtaacccgtaagggtcccgttaccggtccccccggttacggttaccctaccgttcccgttaccggttaccccccg

SEQ ID NO: 166913 - DNA, 578 bp, Homo sapiens
  misc_feature: GYAE6OF02FPTYZ.26.71.G05.1.454.CMB.1.raw
  modified_base (237)..(237): a, c, t, g, unknown or other
  misc_feature (237)..(237): n is a, c, g, or t
  modified_base (342)..(342): a, c, t, g, unknown or other
  misc_feature (342)..(342): n is a, c, g, or t
  modified_base (458)..(458): a, c, t, g, unknown or other
  misc_feature (458)..(458): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccacatcacctgctcggcagacaaagttggganatagaaatgctgcctggtattaccagaggccaggccagtcccctattttggtctatccttccaagataagaagcggccctcgagggactccctgaccgaatttcnggctaccaactcgtacgggtaacacgagaccactctacgaccatcacggacgggcccctaggcccgaaacggactgggaacgggacgacgttaactagttgcgagggcgtaggganagtactagttgtagtgtttgggcggtagggaccgaggcgtacgtaccgtcggtacggtacaccggtaccgacggtccgtccggccccgtcggtacctacttcccggtacgttccccccgg

SEQ ID NO: 166914 - DNA, 746 bp, Homo sapiens
  misc_feature: GYAE6OF02IX9A5.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagcccaccatcacctgctcgcagacaaatggganatagaaatgctgcctggtattaccagacggccaggccacgttccccttagttttcgggtctattccttaccaaagtataaacgaacggccggacccctacgacggggtaacctccccgtacggtaacccgtaaacttttcgtcgggcccttacctaaaccgtcgttagggaaacctacgacgtacccaacttcctacgacccacgtaccgacgggcccggggaccccgaacggtacccgaaaacgggcgtacgggaacgggaacgtaccgttaacgttaacgtttcgtacgaacgggtacgggtacgggtaaacgtaacgttaaccttaagtttacgggttaaggttcgggtttacggtacggggtaacgggtacccgtagggtcccgttacggtacccggttaccggttaacggttccggaaccggtaccccgtaagggtccccgttaccgggtaccccccgtttaccgggtacccctaacccggtttcccttacccggtttcccccccg

SEQ ID NO: 166915 - DNA, 801 bp, Homo sapiens
  misc_feature: GYAE6OF02HY7PH.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggaccagacagccaccatcacctgctcggcagacaattggganatagaaatgctgcctggtacttaccgagacggccaggccacgttccccttagttttcggtctattccttacaagataagaacgcggccctacgacgggtactccctgaaccgtaatttcgcggtcctaccaacttcgtaggaacacgacgcctactctcgacacgtccgacggcccgggtacccaacggtacccgaaacggtacgtacgggaacgggtaacgtaaccgttaacgttacgtttacggtaccggtaacggggtaccgggttaacggggaaacgtaaaccgtttaacggttaaccggttttagggtttaacgggttttacggggtttttacgggggacccggggttaacgggggtaaccccggtaacgggtacccggttaaccgggtaacccccgggtttaccggttaaccggggtacccgtaacccgggtaccccccgggtaaaacggggtcccccgtttaacccccgggtaccccccccggtttccggggttaaccccttaccccggttttaccccggtttacccggtttaccccccccgtaccccctttacccccgg

SEQ ID NO: 166916 - DNA, 640 bp, Homo sapiens
  misc_feature: GYAE6OF02J1XTH.26.71.G05.1.454.CMB.1.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagagactatactcacgaccggtgctcgatttagtgtcgtcgcaagagagagggggcgtgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcgcagacaatggganatagaatgcngcctggtacttacgagacggaccaggccacgttccccgtattttcggtactacgtcttccaagactaagaacggcgaccctagacgggctcccgtacgaccgtaatttcaggtcctaccaactaccgtagggaaccaacgacgaccaccgtctacgaacctataccgaacggccggggaccccacggacccgaacggtagtacggagggacgacttaacgttagttacgacgtaaggtcgtagggaactaagtaccttagtttacgtaggttaggttagggacggtacggaaccgtaggccgtacgggtaccgttaccggaaggttaccgacggtacccgacggtacccgtccggtcccccggtcgtacccgtaccgtccgttaccgttccccccg

SEQ ID NO: 166917 - DNA, 600 bp, Homo sapiens
  misc_feature: GYAE6OF02HC9RJ.26.71.G05.1.454.CMB.1.raw
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccacgtcccctatttcggtcatcttccaagataagaagcgcctnaggatcctgaccgaattcnggctaccaactcgtaggaacacagccactctagaccatccgaggccggggcccaggacccaaggactaggagggacgactactagttcgtacgagggtcgtgggaagtaagtacgtagtttacggtaggttggtttacgggacgggtagggaccgtagggtccgtagggtacccggttacgtacgggttaccaccggtacccgtaacggtccgttacccggaccccccgttacggtccctaccgttcccgttacccgttaccccccg

SEQ ID NO: 166918 - DNA, 639 bp, Homo sapiens
  misc_feature: GYAE6OF02FPD76.26.71.G05.1.454.CMB.1.raw
  modified_base (309)..(309): a, c, t, g, unknown or other
  misc_feature (309)..(309): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggcatcttccaagataagaagcgcctnagggactccctgaccgaatttctggctccaactcgtgggaacacagcccactctgaccatccacggccggggccccaggccgaaacgggataggacgggaagaccgtacgtaattcggtacctagggccgtaggggaagtaaagttacgttagttagttaggttggttttagggaccgggtaggggaccagggtctacgggtacccggttacccgtagggttacccgaacggtaccccgaaacggggtcccgttaccgggtcccccccgttacggggtccctaacccgttcccggtttacccggttaccccccggtccccttacccccgg

SEQ ID NO: 166919 - DNA, 634 bp, Homo sapiens
  misc_feature: GYAE6OF02HAC8S.26.71.G05.1.454.CMB.1.raw
  modified_base (235)..(235): a, c, t, g, unknown or other
  misc_feature (235)..(235): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctcgctaggtactaccagacggccaggcctacgtccccttagttttcggcactcttacaagataagagccgccncgaggactccgngaccgtaatttcgcggcctcaacgtcgtaggaaccgacacgaccactcctcgaccagtccgacgggccgggacccagaccgaaggtcagggacggacactactattcggacgtagggtcggtaagggactaacgttacgttaaggttaggttaacgttgggttttacgggacggggttaggaccgtaggaccgttcggacccgttcggttaaggtaccggtacgaacccggtaacggtccgacccgggtccccgtacggttacccgtaccgttcccggttccggtttcccccgaccgttacccc

SEQ ID NO: 166920 - DNA, 711 bp, Homo sapiens
  misc_feature: GYAE6OF02FYXUB.26.71.G05.1.454.CMB.1.raw
  modified_base (244)..(244): a, c, t, g, unknown or other
  misc_feature (244)..(244): n is a, c, g, or t
tcagagactatactcacgaccggtgctcgatttagtgtcgtcgcaagagagaggggcgtgggccgtcaggaagcagcatcggaggtgcctcagccatggcatggatccctctcttcctcggcgtccttgcttactgcacaggatccgtggccttcgatgagctgattcagccctacctcagtcgtccgtcgtccccaggacacgacacgccaccatccacctgctcggcagacaagttggaganagaatgctgcctaggtacttaccgaggacgccgaggcctacgttaccccttagttttcggactacttccttacgaagtaataacgacggtccgtcccctacgacggggtactcccgttgaacccgttaattcgtacgtctaccacgttacgtacgggaaacacgacgccctacgtcctacgacacgtcgacggtccggggacccacggacccggaacggtagtacgggacgggtaactacgttaacgtagtttacgaccggtaggggtccgtaaggggactaagttaccgttaagttcggttaggttcgggtttgggacggtacgggtaccgtagggtaccgttccggtaacccggttcggtaaccggttccaaccgggtaaccccggtaacgggttccccgtaccccgggtacccccgttacgggtacccgtacccgtttccccgttacccggtttccccccccgg

SEQ ID NO: 166921 - DNA, 524 bp, Homo sapiens
  misc_feature: GYAE6OF02FGBQ8.26.71.G05.1.454.CMB.1.raw
  modified_base (234)..(234): a, c, t, g, unknown or other
  misc_feature (234)..(234): n is a, c, g, or t
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccaggtccccctattttggcatcttccaagataagaagcggccctnacgggactccccgtagaccgtaatttctggctccaactcngggaacacagccactctcgaccatcaggccgggcccagcccaacggangaggganactactattgcaggcgtaggganatactatgtagtgttgcggtagggaccaggctgaccgtcgaggtcacgccaaggcctcgacccctggtcaccgtctcgtcccacccttcccg

SEQ ID NO: 166922 - DNA, 654 bp, Homo sapiens
  misc_feature: GYAE6OF02G498U.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaagtggganatagaatgctgcctgtattacgagagccaggccacgtccccttagtttcgctatcttccaagataagacgcgccctacgagggctcccgtgaccgtaatttctggctaccactcgtaggaacacacgcccactctacgaccatcgacggccgggacccaaggacccgaacggagtacgggaacgggaacgtaaccttacgtaagttcgtacggtacgggacggtaggggtaagtaaacgttacttaaggtttaggttaggtttaggggttttcgggaacggggtacggggacccgtagggtccgttacggtacccggtaccgtacggtccgtaacggaccccgtaagggtcccgttacccggtcccccgttacgggttacccttaccgttcccgttaccccgttaccccctaccccgttaccg

SEQ ID NO: 166923 - DNA, 525 bp, Homo sapiens
  misc_feature: GYAE6OF02G5LBH.26.71.G05.1.454.CMB.1.raw
  modified_base (234)..(234): a, c, t, g, unknown or other
  misc_feature (234)..(234): n is a, c, g, or t
  modified_base (458)..(458): a, c, t, g, unknown or other
  misc_feature (458)..(458): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggcccaggccagtcccctattttggtcatcttccaagataagaagcggccctcagggatccctgaccgaatttctggctccaactctgggaacacagccactctgaccatcagcggggcccagcccaacggatggagggagactactagttgtcgaggcgtgggagaatacgtattgtagtgttggcggagggaccnggctgaccgtctaggtcagcccaaggcctcgccccgtcggtccacgtcgtcgttccccgcccttccg

SEQ ID NO: 166924 - DNA, 738 bp, Homo sapiens
  misc_feature: GYAE6OF02GR6I5.26.71.G05.1.454.CMB.1.raw
  modified_base (229)..(229): a, c, t, g, unknown or other
  misc_feature (229)..(229): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccaccatccacctgctcggcagacaattgganatagaatgctgcctggtacttaccagacggccaggccacgtccccttagtttcggctattccttaccaagataagagccggaccctcgacgggactcccgtagaccgtaatttcgtcggactaccaactcgtacggaacacacgccactctacgacctacgtacgacgggacccgggcccaacggacccgaaacgggacgtacgggaacggggtaacgtaaccgttacgttaacgttacggtaccgtaacggggtccggtacggggtaaacgtaaacgtttaaccggttaagtttacgggtttaacgggtttcgggttttaacggggaccggggttaacggggtaaccgttacgggtccggtaaccgggtacccggttacccggttaagggtacccgtaaccgggtaaccccgaaggggtcccccttaccgggtcccccccggttacgggttaccctaacccggtttccccggttacccgggtttccccccgtacccccgtttacccgg

SEQ ID NO: 166925 - DNA, 721 bp, Homo sapiens
  misc_feature: GYAE6OF02F0MB7.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagtggganatagaatgctgccgtaggtataccagacggccaggccacggtccccttagttttggctacttccttaccaagtataaaggaacggccggaccctcgaagggactccccgtagtaacccgtaattttccgacggtcctaccctaacgtcgtacgggaaaccacgacgccacttcctcggaacctagtccgacgggtcccgggaccctaacggacccgaaacgggagtacgggaacgggtaacgtaccgtaacgttagttcggtacgtacgggtcggtagggtaacgtaacgttacgttaagttgggttaaggtttgggtttacggggacgggtaacgggtaccgtacgggtaccgtaccgggtacccggttaccgtacgggtaccggtaaccggtacccggtaacgggtcccgttacccggtaccccccgttacgggttacccttacccgttaccgtaccccggtttaccccctaccccgtttaccccg

SEQ ID NO: 166926 - DNA, 681 bp, Homo sapiens
  misc_feature: GYAE6OF02IBOC0.26.71.G05.1.454.CMB.1.raw
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (232)..(232): a, c, t, g, unknown or other
  misc_feature (232)..(232): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctnagtntccgtgtccccaggacagaccagccaccatcacctgctcggcagacaaagttggganatagaatgctgcctgtactacagacggccaggccagttaccccttattttcggtctattccttaccaagataagaacgccgtacccgtgacgggtactcccgtagtaccgtaatttcgtcggtcctacccaacgttccaacgggtaaccacgacgtaccaccttcctacgaccgtacgtacgacgggtacggggacccccgtaaggtaccccgaaacgggtagtacgggagggtaacgaacttaacgttattacggtacggacgggtacggtagggaataagttacgtttagtaggtagttggggtttaggacgggaacgggtacgacggtccgtaccggtaccgtaccgtaacgggtacgtaaccggacccgacgggcccgttaccgccccccggttacggtcccgtacccgttacccggtttcccttacccccgtacccgttacccg

SEQ ID NO: 166927 - DNA, 531 bp, Homo sapiens
  misc_feature: GYAE6OF02GANY9.26.71.G05.1.454.CMB.1.raw
  modified_base (231)..(231): a, c, t, g, unknown or other
  misc_feature (231)..(231): n is a, c, g, or t
  modified_base (333)..(333): a, c, t, g, unknown or other
  misc_feature (333)..(333): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
  modified_base (477)..(477): a, c, t, g, unknown or other
  misc_feature (477)..(477): n is a, c, g, or t
  modified_base (525)..(525): a, c, t, g, unknown or other
  misc_feature (525)..(525): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgactgcctggtattaccagaggccaggccagtcccctattttggcatcttccaagtataagaagcggccctgagggactccctgaccgatttcnggctccaatctgggaacacagcccactctcgaccatcaggccgggacccagccaacggntacggagggacactactagttagcgaggcgtggganatacgtattgtacgtgtttggcggtagggaccaggcgtgacccgtacgnggtaccgaggacccaaggcctcgccccgtggtccacctctccgtcccncctccg

SEQ ID NO: 166928 - DNA, 771 bp, Homo sapiens
  misc_feature: GYAE6OF02IVAOH.26.71.G05.1.454.CMB.1.raw
  modified_base (694)..(694): a, c, t, g, unknown or other
  misc_feature (694)..(694): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcacgcccctacctcgtagtcgtccgtccgtcccgagacgacgacaccgccacactacccgtactcgtccgtacggacgaacgtaaacgtaagggttaggaagtaaacgtaaaggtaacgtcgtcgtaccgtaccggtttaagttaaccttaaccggaggtaaccgaccgggcgaccgttaccccgtttaccccgtttttaaggtttcgtaaccttacgtttcccttaaacgaacggtaaataaacgggtaacccggtcccgtaccgttacgggaacggttaccctccgtaaccggtaaccgtttaacgtttcggtacccgtaccgtaaaccctccggttacgtaaacggaacccacgaacccgtacctaacgtcccgtaacgaaccgtacgtaccgaccggggtccccgaaccgaccgacggaacgtggaaggacggtaactacttcgttagtacggtcggacggttggagtaacgtaattaggttacgttgttacgggtttgtaacggggcgtaacggacgtcggtacnccgtacgttcggatcccggacacggtccgcgtaccccgtcccgtacgtcctccgttccgtcccgtaccctcctaccg

SEQ ID NO: 166929 - DNA, 598 bp, Homo sapiens
  misc_feature: GYAE6OF02I85W6.26.71.G05.1.454.CMB.1.raw
  modified_base (238)..(238): a, c, t, g, unknown or other
  misc_feature (238)..(238): n is a, c, g, or t
  modified_base (526)..(526): a, c, t, g, unknown or other
  misc_feature (526)..(526): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctcgctcggcagacaaagttggganatagaatgctgcctgtatacagagccgaggccagtcccctatttcggctatcttaccaagataagaagccggcctcgagggtactccgacgaccgtaattccgtcggcctaccaactcgtagggaaccacgaccgcaaccgtcctagacctactacgacggccgggtcccaacggacccgaacgggatacggacgggacgtaacgtacgttagtcgtacgaggtcggttagggataacgtacgttaagttgtacggttgtttcgggacggtacggtacgaggtaccgngtaccgtcggtacggtacacggacctagacccgtccgaccccggttcgtaccaccttcgtcccgtacccccg

SEQ ID NO: 166930 - DNA, 735 bp, Homo sapiens
  misc_feature: GYAE6OF02FNP10.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagtgggagatagaaatgctgcctggtattaccagacggccaggccagtcccctagttttggtctatccttaccaagtataacgaggccggccctcgacgggacttcccctgaaccgtaatttactggcctacctaactcgtacgggaaacaccgaagccctactaccgtcgaacccatccgaacgggcccggggaccccaacggacccgaaaccgggagtacgggaacggggaacgtaaccgtaacgtttacgttacggtacccggtaacggggtacggtacgggggaaacgttaaacgttaacgtttaacgtttacgggtttaagggtttacggggtttttcggggaccggggttaaacgggggacccgtaaagggttcccgtaagggtacccggttacccggtacgggtacccgtaacgggccccgaaacggggtccctacccggtacccccggttccggttacccgtacccgtttcccgttccggtttaccccccgcccgttaaccccg

SEQ ID NO: 166931 - DNA, 829 bp, Homo sapiens
  misc_feature: GYAE6OF02H20Y2.26.71.G05.1.454.CMB.1.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccacctcagtgtccgtgtccccaggacagacagccacatcactgctcggcagacaattgganatagaatgctncctaggtataccagacgccaggcctacgtcccccttaagttttcggtactactctttacccgaaagtacttaacggaaacgccgggacccttacgacggggactccccgtagaacccgtaattttcgtcgggaccttacccgtaacttaccgtagggaacaaccgacgacccgaacgtcctacgaaccctagtccgaacggcccgggggaccccaacggacccgaaacggtacgtcgaacggggacggttaacctaaccgtttagtttacgggtacctaaggggtccggtaagggggtaacgaaaggttaacccgttaaaggttttaccgggtttaaggtttacggggttttttaacggggtaccgggggaaaccgggggttaacccgtaacgggggttaacccgtttaccggggtaaaccccccggtttacggttaaacccggggtttaccgtaacccgggtaaaccccccggttaaaccggggtccccggtttacccgggttaaccccccccggtttacccggggtttaacccccgtaaccggtttttaccccccggttaccccggtttttaacccccccccgg

SEQ ID NO: 166932 - DNA, 738 bp, Homo sapiens
  misc_feature: GYAE6OF02JM9CK.26.71.G05.1.454.CMB.1.raw
  modified_base (255)..(255): a, c, t, g, unknown or other
  misc_feature (255)..(255): n is a, c, g, or t
  modified_base (601)..(601): a, c, t, g, unknown or other
  misc_feature (601)..(601): n is a, c, g, or t
tcagagactatactcacgaccggtgctcgatttagtgtcgtcgcaagagagagggggcgtgggccgtcgaggaagcagcatcggaggtgcctcagccatggcatggatccctctcttcctcggcgtccgttgcttactgtcacaggatccgtggccttcgatgagctgattcagccaccctcacgtgtccgtcgtccccaggacacggaccagccaaccatccactcgcctcggcacgaactaaagttcgggaanagtagaattgactgtaccgtggtaacttaccgaagtacgggaccgaggcccgtacggttccccttaacgttttcgtacctagttctaccaacgtataacgaagtaccggcctacgacgggactccacgtaaccgtaacttcgtacggccttacccaacttcggtagggaaaccaccgtacgccctaacgtcctacgaccacgtacgaccgggtaccggcccgaccggaccgaaccggtacgtacggaacgggtacgtaaccgttacgttaacgtcggtaccgtacgggtacggtacgggaagtaacgttaaccgttagttacggtttaggttacggttttacgggnggggtaaccggtaacggtacggtaccgtcggtaccggtaccggttaacgggtaccgtacggaaccccgttaaggtacccgtacccgggttaccccggtaccggtacccggttaccggtaccttcccgttaacccccg

SEQ ID NO: 166933 - DNA, 597 bp, Homo sapiens
  misc_feature: GYAE6OF02I5PA2.26.71.G05.1.454.CMB.1.raw
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgccaccctcagtcgtccgtgtccccaggacagacagccaccatcacctgctcggcagacaagttgganatagaatgctgctgtatacngagcncgcagtcccttattgcntctcagataagagcgcctgaggctcngacattcncgctacactcgtaggaacanacnccactcncgactacacagggcccgggaccacggaacccgaggagtcggaaggactaccgttaactagttcgacgtacgggtcggtacgggaagtaaccgttacgttagttacggttagttgggttagggacgggtacggtacgtacgggtaccgtaccggtaccgttaacggttcgggtcgtaacccggtaccgtaacggtcccgttccccgggaccccggttaccggtcctaacccttccggttaccccgttaccccccg

SEQ ID NO: 166934 - DNA, 638 bp, Homo sapiens
  misc_feature: GYAE6OF02JA29X.26.71.G05.1.454.CMB.1.raw
  modified_base (175)..(175): a, c, t, g, unknown or other
  misc_feature (175)..(175): n is a, c, g, or t
  modified_base (233)..(233): a, c, t, g, unknown or other
  misc_feature (233)..(233): n is a, c, g, or t
  modified_base (565)..(565): a, c, t, g, unknown or other
  misc_feature (565)..(565): n is a, c, g, or t
tcagagactatactcacgaccggtgctcgatttagtgtcgtcgcaagagagaggggcgtggcctcaggagcagcatcggaggtgcctcagccatggcatggatccctctcttcctcggcgtccttgcttactgcacaggatccgtggccttcgatgagctgattcagccaccctnagtgtccgtgtccccaggacagacacgccacatcacctgctcggcagacaattggganatagaatgactcggcctaggttacttaccgaggcggaccgacggccaccgttacccctttagttttcggtctaacttccgttaaccgaaagtacgtaaagaacggtccggtccctagacggggtactccccgtacgacgttaacttcgtacggcctaccgtactcgtacggaactacgacgaccctacgtcgtacgacctacgtacgaaccgggccggggccccaaggccccgaaaggtacgtgggaacggtacggtaccttaagtacgttcggacgcggtacggtcggaagtaattacgtagtttaggtaggttgtcgggaggacggacgngtacgtgaccgttccgtggctaccgcccgaagtcccgtccgcccggtagtcaccgttcccgtccgttcccccg

SEQ ID NO: 166935 - DNA, 660 bp, Homo sapiens
  misc_feature: GYAE6OF02J1E61.26.71.G05.1.454.CMB.1.raw
tcagagactatactcacgaccggtgctcgatttagtgtcgtcgcaagagagaggggggccgtcgaggaagcagcatcggaggtgccccagccatggcatggatccctctcttcctcggcgtccttgcttactgcacaggatccgtggccttcgatgagctgattcagccaccctcagtgtccgtgtccccaggacagacacgccaccatcacctcgcctcggcacggacaaattgggagatacgaaattgactgcctggtattaccgagtaggccaggccacgtccccttagtttcggtcatccttccaagtataagagcggccctgacgggactcccgtgaccgtaacgttttcacggccctaccaccttacgtagggaacccacgacgacccactctacgacccattcgacgcccgggcccgacgaccgaaccgggactaggacgggaacgacgtactacgtagtcgtaggtcggtaggacgtaagtaccgttaagttgttaaggttgttttagggacgggtacgggtaccgtagggacccgttggacccgttccgtacgggtacgtaccggtacccggaacggtacccgtccgtaaccccccgttgggtccctaaccgtccgtttacccggttcccccgcccgtttacccgtacccg

SEQ ID NO: 166936 - DNA, 551 bp, Homo sapiens
  misc_feature: GYAE6OF02GKRD2.26.71.G05.1.454.CMB.1.raw
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (384)..(384): a, c, t, g, unknown or other
  misc_feature (384)..(384): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattgggagatagaatgctgcctggtattaccagaggccaggccagtcccctatttggcatcttccaagataagaagcggcctcagggntccctgaccgatttcnggctcactctggaacacagccactctgaccatcagccgggcccacgccgaacggntaggaggacgactactagttgtcgaggcggtagggagtaatacgttagttagtagttgtttggacgggagggaccgtaggcgtcgacccgtcgtacggtcgacggtaccgaacggtcctacggccccgttacggtcctaccgtccgtcgttcccctacccgttcccg

SEQ ID NO: 166937 - DNA, 633 bp, Homo sapiens
  misc_feature: GYAE6OF02FUQH0.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaaattggganatagaaatgctgcctggtattacagagccaggccacgtcccctattttcggtcactcttacaagtataagaagccggccctcgagggactcccgtagaccgtaatttctcggcctaccaactcgtacggaacacacgcccactctacgaccatccgacggccggggcccacggacccgaaacgggactaggaggggactaccgtaacgttagttcgtacgagggtaccggtagggaagtaaagtacgttaagttggttaggttggtttagggacgggtagggtaccgagggtcctcggacccggttccgtaaggtcccgaacgaccccggaaggtccctaccggcccccgttacgggtcctacccgttccgttccggttcccccgtccccttacccg

SEQ ID NO: 166938 - DNA, 731 bp, Homo sapiens
  misc_feature: GYAE6OF02HF11E.26.71.G05.1.454.CMB.1.raw
  modified_base (315)..(315): a, c, t, g, unknown or other
  misc_feature (315)..(315): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggacgcccacgcacgacccctcacgctgacctgctccgtctctggacttctcactcaccacgactggaggtgaagtggtcggccgtcgggtccgtcgaccgggacccccggaaggcccgtggacgtggcttcgctacttctatttacgnggtagtgacttctacgaacgcgtaacacgttccgtctcgtaggaaggtactccgactaccgaacacgtaccgaaccggaacggtaccctaaccgtaacccggtaaaacgggtacccggggtttaccgttaaccttaacgtaacgtaccggtaaccgaacgtaacgtagtaaccttccggttacggtacgaaccgacgaacggacctaacttaacgttacttacggttacgtacgaacctaaccgaccgttaccgtaccgtacggccggtaccgtaacggaacggtaaaagaaacgtagtacgtacggtaacggttacggtaacggggtaccgttaagggtttaccgtttaccggtaacccttccccggtacccgtacccgtacccggtacccctacccggtacccgtaaccccggg

SEQ ID NO: 166939 - DNA, 798 bp, Homo sapiens
  misc_feature: GYAE6OF02F1CJZ.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaatgctgcctggtataccagaggccaggccagtccctatttggcatcttccaagataagaagcggaccgtcggggactcccgtagaccgtaatttcgtcggtctacccaacttccgtagggaaacctacgacgtaccctactcctacggaccctactccgacggtcccggggaccccacggtaccccgaaaccgggacgttacgggaacggggaacggtaaccgtttaaccgttaagtttacgggttaccggtaacggggtaccgggttagggggaaacggtaaacgtttaaccgtttaacggtttaagggttaacgggttttggggtttttacgggggtaccgggggttaaccgggggtaaaccccggtaaacgggggttcccggttacccgggttaacccgggtttaccccggttaggggtacccgtaacccgggtaaccccggtaaaccggggtcccggttaccccggtccccccggttacccgggttacccgtacccgtttacccggttaccccgtttaccccccgttaaccccccgttccccgtttaaccccgg

SEQ ID NO: 166940 - DNA, 543 bp, Homo sapiens
  misc_feature: GYAE6OF02HOSFI.26.71.G05.1.454.CMB.1.raw
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgactgcctggtattaccagaggccaggccagtcccctattttggcatcttccaagataagaagcggcctcagggatcccngaccgaattccnggctccaactctgggaacacagccactctcgaccatcaggccgggccacgccgaacgatggacgggagaccgtactagttacgtcagggtcgtagggagaagtacgtagtcgtaggtgttttcgggcggtaggacaggcgtagaccgttcgtacggtcacggcccgtaaggccgtacgtccccgtggtcctacgtcgtcctaccccc

SEQ ID NO: 166941 - DNA, 643 bp, Homo sapiens
  misc_feature: GYAE6OF02I8VS2.26.71.G05.1.454.CMB.1.raw
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctaagtgtccgtgtccccaggacagacagccaccatcacctgctcggcagacaatggganatagaaatgctgcctggtattaccagaggccaggccagtcccctatttggcatcttccaagntaagaagccgccctcagggctcccgtgaccgtaatttccgnggtctaccaacttcgtacgggaacacacgcccacgtctgacccatccgaaggccggggaccccaacggacccaaacgggacgtacggaacggggacgaacttaaccgttaagtttcggtaccgtaaggggccggtaggggaacgtaaacgttaaccgttaagtttaggttaggtttggttttaggggccgggtaaggggacccgaagggtaccgtcgggtacccgtccggtaggtccgtacggaccccgaacgggtcctaccggcccccgttcggtacccacgtcccgttacgttcccctaccccg

SEQ ID NO: 166942 - DNA, 657 bp, Homo sapiens
  misc_feature: GYAE6OF02HWLBA.26.71.G05.1.454.CMB.1.raw
  modified_base (234)..(234): a, c, t, g, unknown or other
  misc_feature (234)..(234): n is a, c, g, or t
  modified_base (339)..(339): a, c, t, g, unknown or other
  misc_feature (339)..(339): n is a, c, g, or t
tcagagactatactcacgaccggtgctcgatttagtgtcgtcgcaagagagagggggctgggcctcaggaagcagcatcggaggtgcctcagccatggcatggatcccctctcttcctcggcgtccttgcttactgcacaggatccgtggccttcgatgagctgattcagccaccctcagtgtccgtgtccccaggacagacagccacatcacctgctcggcagacaatggganatagaaatgctgcctgtattaccagaggccaggccacgtccccttattttcggtcattccttaccaagataagagccggccctgagggactcctgaccgtattcncggtctaccactcgtagggaacacacgccactctcgaccatcgacggccgggacccacggaccgaaacggacacgggacgggacgtaacgttacttacgttgtaccgaacgggtcggtaggggtaacgtaaacgttacttaggtttacggttaaggttcggtttacggggtacggggtacggacccgtagggtaccgtacgggtacccggtttaccggtaacgggttaccgaaccggtaccccgtaaacggcccgttacccggaccccccggtttccgggtaccctaacccgttcccgttacccggtttacccccccg

SEQ ID NO: 166943 - DNA, 606 bp, Homo sapiens
  misc_feature: GYAE6OF02GRIRH.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcacggcccccggaaaggccctggagtggcttgcactctatttactggagtgatctacaagcggtaacactccgtctctgagatcgactcacatcacgaggaccacctacaaacgccgggtgtcctaacatcgaccgacatagactccgtgtacggacacgaggcaactattacttacgtgtcgacactacacgttaccgtacgccggtaccgtaccggaacgaaaggtaaaaacgagttagtacgtaacgttaggttaccgggggaaccgttaaggggttaacgtttttcgggtaccgtaccccggtttcctaccccccgtaacgtccccttaccccgaaccgtaaaccccgggg

SEQ ID NO: 166944 - DNA, 657 bp, Homo sapiens
  misc_feature: GYAE6OF02I9OYO.26.71.G05.1.454.CMB.1.raw
  modified_base (173)..(173): a, c, t, g, unknown or other
  misc_feature (173)..(173): n is a, c, g, or t
  modified_base (233)..(233): a, c, t, g, unknown or other
  misc_feature (233)..(233): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtgccttcgatgagctgattcagccaccctnagtgtccgtagtccccaggacagacagccaccatcacctgctcggcagacaaattggganatagaatgctgcctggtattaccagagccaggcagtccctatttgcatctcaagataagagcggacctgaggactcccgngaccgtaatttcgngctaccacttcgaggaacacagccaactctagaccagtcgaacggcccgggtacccaggaccccgaaacggacgtaggaacggggtaactaaccgtaacgttacggtttagaccgacgggtcgggtacggggaaagtaaacgttacgttaagttacggttaacggtttgggtttaccgggaccggggtaacggtaacccggtagggtaccgttaccggaacccggttccggttaaggacccggaacggtaccccgtaagggtccctaccgtccccccggttacggtccctaacccgtccggtttaccgtacccccggtcccttaacccgg

SEQ ID NO: 166945 - DNA, 848 bp, Homo sapiens
  misc_feature: GYAE6OF02FWE3V.26.71.G05.1.454.CMB.1.raw
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgganatagaaatgctgcctggtattaccagagcnggccagtccctatttggcatctccaagataagaagcgccctnaggatcccngacgtattcncgctccgtaactcgtagggaactacgacgacccgtaacttccgtacggaaccctaacgttaccgaacggggtaccccgggggggtacccccctaaacgggggcccccgaaaaaccggggggtaccgttaacgggggaaaccgggggaaaccggtaaacccgttttaaacccgtaaagggtttttacccgggtaaccggtaacgggggtacccgggtttaaggggggtaaaccggttaaaacgtttaaacccgttttaaaggttttacggggtttaaacggttttaccggggttttttaaggggtaacccgggggtaaaacggggttaaaccccgggtaacggggttacccggtttaccggggtaaccccggtttaccccgggttaaacggggttacccgtaaaccggggtaccccccggttaaacggggtccccggttaccccggggtacccccccgtttaacccgggggttacccctaccccggtttacccggttaccccgttttaccccccccccgggg

SEQ ID NO: 166946 - DNA, 766 bp, Homo sapiens
  misc_feature: GYAE6OF02IUQOE.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggacagaacaaattgggagatagaaatgctagcctggtaattaccaggacggccaggccacggttcccctagttttggctattcttaccaaaggtaataaacggaacgccggtaccccttacgaacgggtacttccccgtacgtaacccggtaaattttcgtacgggtaccttacccgaaaccttccgttacggggaaaaccaacgtaacggacccctaaccttaccgtaccggaacctacgtacccggaaccgggacccgggggaccccacggaacccgaaacgggagtacgggaacggggtaacgtaaccgttaacgttaacgtttacggtacgtaacggggtacggttaaggggaaacggtaaattacgttaagtttaggttaaggttggtttagggacggggtaacgggaccgtaagggccgttacgggtaacccggttaccgtaacgggtaccggaacggtaacccgtaacgggtcccgtaccggtccccccggtacgggttccctaccgttcccggttaccgttcccccggtccccgttaacccgg

SEQ ID NO: 166947 - DNA, 748 bp, Homo sapiens
  misc_feature: GYAE6OF02HXJH2.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtacttacagaggccaggccacgtccccttagtttcggtctatcttaccaagtaataagaacgccggccctcgagggtactcccgtagtaacccgtaatttcgtcggtccttacccaacgtccgtacgggaaccacgacgaccctactactcgaccacgtccgacgggcccggggaccccaacggtacccgaaaccgggtacgtacgggaacggggtaacgtaaccgttaacttaagttacggttacggtaacggggtacggtacggggtaaacgtaaacgtttaacgttaagttttaacggttagggtttaggttttacggggtacggggtaacggggtaacccggtaagggtcccgttacgggtaccccggtttaccgtaacgggtcccgtaaccggtacccggtaaacgggtcccgttaccccggtaccccccgttccgggttacccgtaacccgtttcccggttccccggtttaccccccggtccccttaaccccgg

SEQ ID NO: 166948 - DNA, 689 bp, Homo sapiens
  misc_feature: GYAE6OF02IQ77B.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggcccacgtcccccttagttttggtcattcctccaagataaagaacggccggcctcgagggactccccgtaggaccgtaatttcgtaggcctacctaactcgtacgggaaaccacagaccctactcctacgaaccactccgacggacccggggtaccccacggaaccccgaaacgggtacgtagggaacggggaactacgtaactagttcggtacgagggtcggtagggaagtaaacgttacttagtttaggttaggttggtttcggggacggtaccggggtaccgtacgggtcgtaccggtaaccggttaccggtaggtccgaacggaaccccggtaagggtcccgttaccccgggtcccccgttccgggtaccctacccgttacccggtttcccggttaccccccgtccccgttaccccg

SEQ ID NO: 166949 - DNA, 775 bp, Homo sapiens
  misc_feature: GYAE6OF02JNSR1.26.71.G05.1.454.CMB.1.raw
tcagagactatactcacgaccggtgctcgatttagtgtcgtcgcaagagagaggggtccatgccatggcatggatcctctcttcctcggcgtccttgcttactgcacaggatccgtggccttcgatgagctgattcagccacctcagtcgtccgtgtccccaggacacgacacgccacatcacctgctcggcagacaaagttggagatagaatgctgctggtactacagagaccaggccacgttccctagtttcggtctacttcttacaagtaacttaaaggacggccggtaccccttaggacgggtacttccccgtaggtacccggtaattttccgtacggccttaccgtaacttcgtacgggaactaccgacgtccacgtctacgacctagtaccgaggtcccggggctaacggacccgtaaacgggactcgggaagggacgtaaccgtaacgttacgttcgtaacggtacggtacggtacgggtaagtaaacgtacgttaggttaggttacggttaggttttacgggtacgggtacggggtaaccgtacgggtaccggtacggtacccggttaccggttaaccgggtacggaccggtacccgggtaccggtaccggtacccggtacccccggtacgggttacccgtacccgttaccgtttcccggttacccccgggttcccttacccggttcccgttaaccggttaacctttaacccgggttaccgttacccggttaccgggtacccgggtccgggttacccgttaccgggg

SEQ ID NO: 166950 - DNA, 698 bp, Homo sapiens
  misc_feature: GYAE6OF02H2YK4.26.71.G05.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
tcagagactatactcacgaccggtgctcgatttagtgtcgtcgcaagagagagggtccatgccatggcatggatccctctcttcctcggcgtccttgcttactgcacaggatccgtggccttcgatgagctgattcagccaccctcagtgtccgtgtccccaggacagacagccaccatcactgctcggcagacaaatggganatagaaatnctgcctaggtattaccagaggccaggcacgtccctatttcggcatcttcaagataagagacgcctagaggactcccagaccgtaatttcnggcctccaactcgtaggaacacacgccaacgtctacgaccatacgacggccggggacccacggacccgaaacggcggtacggaacggggaacgtaccgttaacgtaagtttaccgtaacggtaaggggtaccggtaggggggaaaacgtaacgtttaaaccgtttaggttttacgtaaggggttttcgggttttagggggtaccgggaacggggtaaccggtaacggtcgttaccgggtaaccccggtttacgtaccgggtacgaaccggtccccggaaaggtcccgtaccgtacccccggtcggttacctacccggttccgttccgttacccccgaaccttcccgtacgtaacgttcgttacgtccctgttaccggacggttccggacgttcggg

SEQ ID NO: 166951 - DNA, 815 bp, Homo sapiens
  misc_feature: GYAE6OF02JURJC.26.71.G05.1.454.CMB.1.raw
  modified_base (176)..(176): a, c, t, g, unknown or other
  misc_feature (176)..(176): n is a, c, g, or t
  modified_base (248)..(248): a, c, t, g, unknown or other
  misc_feature (248)..(248): n is a, c, g, or t
tcagagactatactcacgaccggtgctcgatttagtgtcgtcgcaagagagaggggctgggcctcaggaagcagcatcggaggtgcctcagccatggcatggatcctctcttcctcggcgtcttgcttactgcacaggactccgtggccttcgatgagctgattcagtccaccctnagtcgtccgtgtccccaggacagacacgcctaccactccgacctcgcgtccggctacgacaaagttgggganatagaatgctgccgttaggtacttaccgaggacgtccgacggcctacgttaccccttagtttcggtctattccttaccaagtaactaaggtaacgccggtacctcgaggtacctacccgtcgtaaccggtattttaccgacgtacccttaccgtaacgtccgttacggggaaccaacgacgtacccgtaccgtacgttccgaaacccgacgttaccggaaccgggttacccggggaccccgtaacggaccccggtaaagggtaccgtaacgggaagggtaaacccgtacgtttaaaccgttacgtacgggttacctaagggggtaccctaacgggggtaaactaaaccgggtttaacgtttaacggtttacggggtttacgtttaccgggggtttaaccggtacgggggttacggaacccggttaaggggtccgttacccggtaccgggttaccggttaaccggggtaccaaccggggaacccgttaacccgggtcgttaccccgggttcccccgtaaccgggttcccgtaacccgtttccccgggttacccgtttaacccccccgg

SEQ ID NO: 166952 - DNA, 637 bp, Homo sapiens
  misc_feature: GYAE6OF02IXQD2.26.71.G05.1.454.CMB.1.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaaagttcggganagtaanaatgactgcctaggtacttaccgagacggccgaggccagtccccttattttgggtcattccgtccaagataagaacgcggaccctgaggctcctagaaccgtatttcgtcgacctaccaacgtcgtacgggaacacgacgccactctacgaccactcgaacggcgggacccaacgacccgaacggacgtcggaacgggacgtaccgtacttagtacgtacgagggccgtagggagaacttactagttacggtagttacgttgggacgggtaggtaccgacgggtaccgtacgggtacccgtacgttacggtaccgacggtacccgacggtccgtaccggtacccccgttacgggtacctaccgttccgtacccggtttaccccgcccttaccgg

SEQ ID NO: 166953 - DNA, 505 bp, Homo sapiens
  misc_feature: GYAE6OF02HYBRP.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaaattgggagatagaaatgctgcctggtattaccagaggccaggccagtcccctattttggtcaatcttccaagataaagagcggccctcaggggatcccctgaccgaattctggctcaactctgggaacacagccactctgacatcagcggggcccagccaaacggatgagggagactactatgtacaggcgtgggagaatactattgtagtgtttggcggaggaccaggctgacgtccgaggtcagccaagctggcccctggtcactctgttcccc

SEQ ID NO: 166954 - DNA, 743 bp, Homo sapiens
  misc_feature: GYAE6OF02GV06U.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtcgtccccaggacagacacgccaccatcacctgctcgcagacaagttgganatagaatgctgctggtactaccgagacggccaggccacgtccccttagttttcggctactcttaccaagaataacgaacgcccggtccctacgaacgggtacttaccccgtaggtaacccgtaaacttttccggtacggtaccttacccgtaaaccgttcggtacggggtaaacccaacgtaccgtccccgtaaccgttccgtacgaacccctaacgtaccgtaaccggggccccgggggtacccccaacggaccccgaaacgggtacgtacggggtaacgggaacgtaaccgttaacttacggtttcgtaccggacggtacggtacgggaagtaaacgttaacttaggttacggttaggttcgggtttacgggcgggaacggtaccgtagggtaccgtaccggtacccggtaccgtaagggtacccgaccggtacccggtaacgggtccctacccggttcccccggtcggttacccgtccgtttcccggtcccgttaccccccgg

SEQ ID NO: 166955 - DNA, 659 bp, Homo sapiens
  misc_feature: GYAE6OF02GLTMR.26.71.G05.1.454.CMB.1.raw
  modified_base (430)..(430): a, c, t, g, unknown or other
  misc_feature (430)..(430): n is a, c, g, or t
tcagagactatactcacgaccggtgctcgatttagtgtcgtcgcaagagagagggggggggcctcaggaagcagcatcggaggtgcctcagccatcggcgatggatccctctcttccctcggcgtccttcgcttactgcacaggatccgtgggcccttcgatgacgctagtattcacgcccacccctcagttgtccggttcgtccccaggacagacagcccaccactccacctgcctcgggaccagaactaaagttgggagtagtaagtaaatgctgccttaggtacttaaccagacggccaggaccaccgtaccccttatttggtcctatcgtaccgaagataacggacgccggtacctcggtacgggctcccgtgtaaccgtatttcgtcgcctaccgaacttcgtacggaacacgacgcctactccncgtaccatccgacggtcccgggacccacgccgaacggagagggaggtacgtaccttatagttcgcgtaggtcggtagggtaatagttacgtagttaggtagttgttaggtcgggtacggtacggtacggacgtacgtaccggtacgtacggtcgaccggtaccgacggccgtaccggcccccgttcggtacccgtaccgttccgtcccgttacccctacccgttacccg

SEQ ID NO: 166956 - DNA, 507 bp, Homo sapiens
  misc_feature: GYAE6OF02IHLTT.26.71.G05.1.454.CMB.1.raw
  modified_base (185)..(185): a, c, t, g, unknown or other
  misc_feature (185)..(185): n is a, c, g, or t
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctnacgctgacctgctccgtctctggattctcactcaccacgactgaggtgaatgtggcctgggtccgtcaggcccccggaaaggcccctggagtggcttgcactcatttactggagtgatctcaagcggtacaatccgtctctgagatcgactcaccatcacgaggacacctcaaagccgggtgtccttacatgaccganatgaactctgtgacacgaggcacattatactgtgcanacagtcctagcgctacgngaagaaanatangactagtcgggaccagggtactttggactacgtctcccagccctaccgactaccggg

SEQ ID NO: 166957 - DNA, 718 bp, Homo sapiens
  misc_feature: GYAE6OF02JI03X.26.71.G05.1.454.CMB.1.raw
  modified_base (228)..(228): a, c, t, g, unknown or other
  misc_feature (228)..(228): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgcccgtgtccccaggacagacagccacatcacctgctcggcagacaagtgganatagaatgctgcctgtactaccagacgcaggccagtccctatttggctatcttacaagagtaagaacgccgaccctagaggtacctcccgtagtaccgtaacgtttcgtacggaccttaccgaacgttcgtacgggtaaccaacgtacggccctaactccgtacggtaaccctacgttaccgacgggtaccgggacccccaggtaaccccgaaacgggtacgttacgggaacggggtaaccaacgtttaaccgttacgttacggtaccgaacgggtcggtacgggtaacaaccgttagttaaccgtttaggtaggttacggttttacggggaccgggtaagggtcccggtaaggtaccggttacggtaacccgtttacgtacgggtaacctaccgggtaacccgtaacggggtccctaccggtccccccgtacggtcccgttaacccgtttccgggttacccgtttccccccggacccgtttaaccccgg

SEQ ID NO: 166958 - DNA, 757 bp, Homo sapiens
  misc_feature: GYAE6OF02JK4QI.26.71.G05.1.454.CMB.1.raw
  modified_base (178)..(178): a, c, t, g, unknown or other
  misc_feature (178)..(178): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctnagtgtccgtcgtccccaggacagacacgccaacactccacctcgctcggcaacgaacgaaagttgggagaataagaaatcgtctcgaccttggtaacttaccaaggacggccaggcctaaccgttccccttaagttttcggacctacttaccttaccgaagtaagtaaagacgtccggacctacggaacgggtactccccgtaggaaccgtaagtttccgacggtacctaaccgtaaacgtcgttaacgggaaaccgtacaacgtacccgtacttctaaccggtaacctaacgtccggtaaccggacccggggtaacccgaccggaacccgtaaacgggaggtacgggaacgggaacgtaaccgtaaccgtttaagttccggtacggacgggtacggttaaggggtaacgtaaacgttaacgtaacgtttagttaacgggttacggtttacgggaccgggtaacgggaccggtaggaccgttacggtccgtaccgttcgggtaccgaacggtacccgaacgggtcccttacccggtccccggttacggtacccgtacgtcccgttacccggtacccccg

SEQ ID NO: 166959 - DNA, 692 bp, Homo sapiens
  misc_feature: GYAE6OF02H2BR9.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccaccatcacctgctcggcagacaattgganatagaatgctgcctggtattaccagaaggccaggccacgtcccctaattttggctatccttccaagataagaacgtccggacccctcagggactccccgtgaaccgtatttccgacggcttaccaactcgtagggtaaaccacgacgtccaacttccgtacggaccctaatcccgaacggggtcccggggacccccaacgggaccccgaaaaccggggaatacggggaacggggtaacgtaaccgttaactaaggtttcggtaaccgaggggtacccggttagggggaactaaaacggtacgtttaacgttgggttaacgttagggtttcgggacgggttacgggacctagggccgtagtaccggttccgaaggttccgaaggtccccgaagggtcccttacccggtcccccgttacggtcaacccgtttccgtaccggtttcccccgacccttaccccgg

SEQ ID NO: 166960 - DNA, 543 bp, Homo sapiens
  misc_feature: GYAE6OF02GWGJ1.26.71.G05.1.454.CMB.1.raw
  modified_base (430)..(430): a, c, t, g, unknown or other
  misc_feature (430)..(430): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgctggtattaccagagccaggccagtcccctatttggtcatcttccaagataagaagcggccctcagggatccctgacccgaatttctggctccaactctagggaacacacgccactctgaccatcagcgggcccagcccaaacggatacggagggacgactaactattgtcacggcgtagggagaatacttagttgtaacgttggtttagngggacgggtacgagggctacgaccgtcgtaggtcgaacgccgaaggcctcgcccctgccactcgtcgttcccgcccttctactacgtactagtcctacgtgcgtcggctacgg

SEQ ID NO: 166961 - DNA, 574 bp, Homo sapiens
  misc_feature: GYAE6OF02FPLGH.26.71.G05.1.454.CMB.1.raw
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccctattttggcatcttccaagataagaagcggccctcagggactccctgacgaatttcnggctcaactctgggaacacgagccactctcgaccatcgagcgggcccagccaacggatggagggagactactattcgacgaggtcgnggganaattactagttgtagttaggttggngggtagggaaccgnggcctggacccgtaccgtacggtccgaacggtaccccgaaaggtcctccggtccccccgttcggtaccctacccgttcccgttccgttccccccgaccccttccccgg

SEQ ID NO: 166962 - DNA, 561 bp, Homo sapiens
  misc_feature: GYAE6OF02G8WAK.26.71.G05.1.454.CMB.1.raw
  modified_base (233)..(233): a, c, t, g, unknown or other
  misc_feature (233)..(233): n is a, c, g, or t
  modified_base (431)..(431): a, c, t, g, unknown or other
  misc_feature (431)..(431): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaaatgctgcctggtattaccagaggccaggccagtcccctattttcggcatcttccaagataagaagcggccctcgaggatcccctgaccgaatttcgtggctccaactctagggaacacagccactctgaccatcagccgggcccagccgaacggataggagggagactactagttgtcgaggtcgtaggganaatacgtattggtagttggttgggcgggtagggacgagggctcggaccgtccgtaggtacacggtcccgaaggcctaccggcccccgttcggtccctaccgttccgtccgttaccccctacccgttcccg

SEQ ID NO: 166963 - DNA, 634 bp, Homo sapiens
  misc_feature: GYAE6OF02IN1IW.26.71.G05.1.454.CMB.1.raw
  modified_base (237)..(237): a, c, t, g, unknown or other
  misc_feature (237)..(237): n is a, c, g, or t
  modified_base (345)..(345): a, c, t, g, unknown or other
  misc_feature (345)..(345): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtattaccgagaggaccaggccagtccccttatttggtcatcctccaagataaggaacgcggccctcgaggatcccgtagaccgtaatttcnggtcctaccaacttcgtacggaacacgacgaccctactccacgaccctagtccgaggccccggggaccccagacccgaaaggacgtaggaagggacgtacctaagttacttgtacgacgggaccgtagggaacgaagttacttagtttagtaaggttcggtttagggacgggaagggtacccgaagggtccgtacggtacccgttacgtaacgggttccgaaccggtcccgaacggtcccgtccggtccccgtccggtacccggaccttcccgttacggttaccccccg

SEQ ID NO: 166964 - DNA, 528 bp, Homo sapiens
  misc_feature: GYAE6OF02FZLPV.26.71.G05.1.454.CMB.1.raw
  modified_base (314)..(314): a, c, t, g, unknown or other
  misc_feature (314)..(314): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagcccaccatcacctgcctcggcagacaaattgggagatagaaatgctgcctggtattaccagagccaggccagtcccctatttggtcatctccaagataagaagcggccctnagggactcctgaccgaatttctggctccaactctgggaactacagccactctcgaccatcaggcgggcccagacccaacggatggaggacgactaactattagtcagggcgtgggagaatacgtagttagtagttgtttgggacggagggacagggctgaccgtccgtaggccagcccgaggcctcggccccgtcgtcacgtcctcgtcccccg

SEQ ID NO: 166965 - DNA, 524 bp, Homo sapiens
  misc_feature: GYAE6OF02F9I8G.26.71.G05.1.454.CMB.1.raw
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggcatcttccaagataagaagcggccctcagggntccctgaccgaatttctggctccaactctacggaacacagccactctgaccatcagcgggcccagccgaacggatggagggagactactattgtcaggcgtagggagaatacgtattggtagtgtttggcggaggaccgaggctgaccgtcgtaggtccgacgcccaggctcgccccgtcggtccactcgtcgttcccgccctcccg

SEQ ID NO: 166966 - DNA, 651 bp, Homo sapiens
  misc_feature: GYAE6OF02JX8G1.26.71.G05.1.454.CMB.1.raw
  modified_base (141)..(141): a, c, t, g, unknown or other
  misc_feature (141)..(141): n is a, c, g, or t
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
tcagagactatactcacgaccggtgctcgatttagtgtcgtcgcaagagagagggggggccgtcgaggaagcagcatcggaggtgcctcagccatggcatggatccctctcttcctcggcgtccttgcttactgcacaggntccgtggccttacgatgagctgattcacgcccaccctcagtcgtccgtcgtccccaggacagacacgccaccatccacctgcctcggcagaacaagttgggaanatagaatgctagctaggtacttaccagacgccaggccacgtccctagtttcgactntcctacaagntaagagcgtccngaggtctccgngaacctattcgngtacctcaactgtacggaacncacgccactacgcgacntcgacggccggcccgaaacgccgaacgacgtaggacggacgactatacgttagcgtacggcggtaggtaagaagttacgttagttagtacgttggtttacggacgggtacggtaccggaggtaccgacggttacccgtacggtacggtaccggtaccggtaacccggtacggtacccggttacccggaccccccggttacccggttacccccggtacccgttacccggtttaccccggttacccccgtacccccgtttaacccccgg

SEQ ID NO: 166967 - DNA, 639 bp, Homo sapiens
  misc_feature: GYAE6OF02FWQ3Y.26.71.G05.1.454.CMB.1.raw
  modified_base (206)..(206): a, c, t, g, unknown or other
  misc_feature (206)..(206): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctgtattaccagagccaggccagtcccctatttggtcatcttccaagataagacgcggccctacgagggatcccgtagaccgtatttctaggctaccaactcgtgggaacacagccactctacgacatcgacggccgggcccacgccgaacggatggagggacgacgtactaagttgacgacggtcgtagggagtaatacttagttgttagttgtttcgggacggtacgggtaccgtaggtccgtacgtacccggttacgtacgggtccgaacggccccgtaaagggcccgtacccggtcccccgttaccgggttaccctaccgttccgtttacccggtttcccccctacccgttcccttacccgtacgtttaaccttacggtttccttaccggttggaccggtccgggtcgttaccgggg

SEQ ID NO: 166968 - DNA, 675 bp, Homo sapiens
  misc_feature: GYAE6OF02GD1BJ.26.71.G05.1.454.CMB.1.raw
  modified_base (246)..(246): a, c, t, g, unknown or other
  misc_feature (246)..(246): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcatccttgcttactgcacaggatccgtggccttcgatgagctgattcacgcccaccctcagtcgtccgtcgtccccaggacagacacgccaccatccacctgcctcggacagaacaaagttggganataagaatgctgcctaggtactaccgagacggccacggccacgtccccttagttttcggtctattccttaccaagtataagaacgccgccctacgacggactcccgtacgaaccgtactttcgtcggtacctacctaactcgtacggaaccacgacgcctactcacgaccagtaccgacggcccgggacccacggaccgaacggagtcggaacggtacgtactacgttacgttacgacgtacgggtacgggtagggaaacgtaacttacgttaagttggttacgggttgggtttaccgggacgggtaaccgggtaccgacgggttaccgtaccggtaccggttccggttaacggtaccgtacccggacccggtacggtaccccgttcccggtcccccgttacggtacccttaccgtcccgttacccccg

SEQ ID NO: 166969 - DNA, 642 bp, Homo sapiens
  misc_feature: GYAE6OF02JHF7K.26.71.G05.1.454.CMB.1.raw
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (562)..(562): a, c, t, g, unknown or other
  misc_feature (562)..(562): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggcagacacgccacatcacctgctcggcagaccaaagttggaagatacgaaatgctgccttggtattaccgagacgcaggaccagttccccttaagttttcggcgacttacgttaccaaaggactaaagaacgccggtacccagnggaactcccgtagaaccgtaatttccnggcctacactcgtaggaactacgacgctaaccgtnacgtaccaactcacgggaccgggacccacggacccgaacgacgtagggacggtacgacgtactaagttccgtaacggaggtcggtaggaagtaatacgttattaggtagttggttagggacgggtacggaagttacggctaggttaccggtcttaacgggtacccnggtaacccggtacggtccgtcccggttacccgtcccgttacgttacctacccggttcccgttccccgtccccgttcccgg

SEQ ID NO: 166970 - DNA, 766 bp, Homo sapiens
  misc_feature: GYAE6OF02JI8UT.26.71.G05.1.454.CMB.1.raw
  modified_base (235)..(235): a, c, t, g, unknown or other
  misc_feature (235)..(235): n is a, c, g, or t
  modified_base (353)..(353): a, c, t, g, unknown or other
  misc_feature (353)..(353): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaagttggganatagaatgctgcctggtattaccgagacggccaggcccagtccccttagttttcggactattccttccaagactaagaacgccggaccctgagggactccccgtgaccgtaatttcgnggccttaccaaccttcgtacgggaaccacgtacgccctaacgttcctacggaaccctaagttcccgacgggtacccggggaccccaaggacccccgtaaacgggtacttacgggaacgggtaacgtaaccgttaaccgttaacgtttacggtaccggtaacgggtccgggttaaacggggaactaaaccgttaaccgttaaggttttacgggttaacggtttacggggttttacgggaaccggggttaacggggtaacccgtaagggtacccgttaacgggtaaccccggtttccgttaacgggtaccgtaaccgggtaccccgtaaaggggtcccctaccgggtaccccccgttcgggttaccctaccccgttaccggtttacccggttcccccgtaccccgtttaccccgg

SEQ ID NO: 166971 - DNA, 813 bp, Homo sapiens
  misc_feature: GYAE6OF02JMW3P.26.71.G05.1.454.CMB.1.raw
  modified_base (148)..(148): a, c, t, g, unknown or other
  misc_feature (148)..(148): n is a, c, g, or t
  modified_base (780)..(780): a, c, t, g, unknown or other
  misc_feature (780)..(780): n is a, c, g, or t
tcagagactatactcacgaccggtgctcgatttagtgtcgtcgcaagagagagggggcgtgggccgtcgaggaagcgagcaatcggaggtgccgtcagccatggcatggatccctctcttcctcgcgtcttcgcttactgcacagganccgtggccttcgatgagctgattcagccaccctcagtcgtccgtcgtccccgaggaccaggaaccacggcccaaccctatacccaaccctgcccgttcgggccaacgaccaaaaacgttgggaacggtaataacggtaaaagttcggcttacggacccgtttacgggttaactttaaaccccggtaacgtaaccgggtaccccggtaacgggaccccttaaccggttaccccccgttttaacgtttttccgggtaccgttaacgtttacccgtttaacccgtaaaacgttaagttaaaacggtaaaccggtacccggtaccccgtaccggtaacgggtaacgttaccccgtacggaaccgtttaaacgttttccgacggtaccttacctaaccgtaccgtacgggaaacctaacgaccaccgtaacccttccgtaccgacctacgttaccgaacggtcccgggaccctaaccggaacccgtacgggtacgtacgggaacgggtaactaccgtaacgttagtacgtaccggaggtcggtaggaacggtagtacgttaacgttgttacggtgtttacgggcggtacggacggacgacgttcggaccgtacgtcgggtacacggactccggtacnccggtaccccgtgcccgtatcccgtctcccccg

SEQ ID NO: 166972 - DNA, 718 bp, Homo sapiens
  misc_feature: GYAE6OF02GJSUG.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggagatagaaatgctgcctggtattaccagagccaggccagtcccctatttggtcatcttccaagataagaagcggcctcgagggactcccgtgaccgtaatttctggtcctaccaactcgtagggaacacacgccactctacgtaccatacgacggccgggacccacggacccgaaacgggactagggaacggggtaagtaaccgtacgttaacgtttacggtaccgacggggtccgggtaggggtaacgtaaacgttaacgttaacgtttagggttacggtttacggggtttttcggggaccggggtaacggggtaaacccgtaggggtaccgttaccgggtaacccggttccggttaaccgggtacgtaacccggtacccggtaaaccgggtacccgtttacccggtccccccccggttacgggttaccccgtaacccggtttcccgtttacccggtttcccccccggtacccccgtttacccccgg

SEQ ID NO: 166973 - DNA, 680 bp, Homo sapiens
  misc_feature: GYAE6OF02H7N1M.26.71.G05.1.454.CMB.1.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (410)..(410): a, c, t, g, unknown or other
  misc_feature (410)..(410): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcactgctcggcagacaaatgggagatagaaatgctgcctggtattaccagacggccaggccagtccccttattttggtcatcttccaanataagaagcggacctgagggactcctgaccgtaatttcnggtctccaactcgtacggaacacgagcctactctacgacctagtccgacggccggggcccagacccgaacggntacggagggacgaacctacttagttcgtacgacgggtcggtagggaacgtaaacgttaacgtagtttacggttaaggtttcgggttttacgggacggggtaacgggtaacccgtagggggtaccttacgggtaccccgggttaccggttaacggggttaacccgaaccggggtaacccccgtaacggggtccccttacccgggtccccccccgttaccggggttaccccgtaaccccgtttcccggttacccggttttaacccccccccg

SEQ ID NO: 166974 - DNA, 693 bp, Homo sapiens
  misc_feature: GYAE6OF02HFPPF.26.71.G05.1.454.CMB.1.raw
  modified_base (176)..(176): a, c, t, g, unknown or other
  misc_feature (176)..(176): n is a, c, g, or t
  modified_base (239)..(239): a, c, t, g, unknown or other
  misc_feature (239)..(239): n is a, c, g, or t
  modified_base (353)..(353): a, c, t, g, unknown or other
  misc_feature (353)..(353): n is a, c, g, or t
  modified_base (681)..(681): a, c, t, g, unknown or other
  misc_feature (681)..(681): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcacgccaccctnagtcgtccgtcgtccccaggacagacagccaccatcacctgctcggcacgacaagttgggaanataagaatgctgtccgtggttaacttaccgagacggccaggccaacgtccccttaattttcggcctattccttaccaagataagaacgcggcctgaggctcctgaccgtattcngctacactcgtcggaacacgagccctactctacgacctagtccacgggccgggtacccacggtacccgaaacgggtacgtacgggaacggggaactaccgttaacgttaggttcggtaccggaacgggtacggttacggggaaagtaacgtttaacgttaagttttacgggttaaggtttcggggtttaaggggaccgggtaacggggtaccgtaacgggtccgtaccgggtaacccggttccgttaaggggcccgaacggtaccccggtaagggcccttacccgggaccccttacgggtcctaccgttcccggttccggttcccccncccgtttacccg

SEQ ID NO: 166975 - DNA, 686 bp, Homo sapiens
  misc_feature: GYAE6OF02GER9C.26.71.G05.1.454.CMB.1.raw
  modified_base (236)..(236): a, c, t, g, unknown or other
  misc_feature (236)..(236): n is a, c, g, or t
  modified_base (348)..(348): a, c, t, g, unknown or other
  misc_feature (348)..(348): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccaccatcacctgctcggcagacaaagttggganatagaaatgctgcctggtacttaccagaggccaggccacgtccccttattttggtcattcttccaagataagaagccggccctacgagggactcccgtagaccgtaatttcncggctccaacgtctacgggaacacacgcccactcctagaccatacgacggacccggggacccacggacccgaaacgggacgtacgggaacggggacgtaaacctaacgtaacgtttggtaccgtaacggggtaccgggttagggggaaacgtaaagtttaaccgttaaggtttacggttagggtttacgggtttttcgggaacggggtaacggggtaaccgaggggtcctacgggacccgttaccgttacgggtaccgaacggtaccccggaacggtccgtacccggtcccccgttacggtcccgtaccgttccgtccgttccccggtcccttacccg

SEQ ID NO: 166976 - DNA, 676 bp, Homo sapiens
  misc_feature: GYAE6OF02F0S15.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacagccaccatcacctgctcggcagacaaagttggganatagaaatgctgcctgtacttacgagacggccacggaccacgtccccttagttttcggtctactccttaccaaagtagtaaagaacggccggccccgtacgaacgggacttccccgtacggaccgttaactttcgtcggtcctaccctaactccggtacgggaacctacgacgtacccacttcctacgaacctacgtaccgaccgggtccggggaccccaacggcccgaaacggcggtacggacgggtaacgtacgtacttaagttcgtacgacgggtcggtagggagtaacgttagtaacgtttggttacggtttaggtttcgggacggtacgggacgtcggtcgtacggtccgtaccggttggaccctacgacccggtaaggcccgttacccggccccggttaccgtccgtaccgttccgtcccgttcccccgg

SEQ ID NO: 166977 - DNA, 640 bp, Homo sapiens
  misc_feature: GYAE6OF02INXF4.26.71.G05.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatccacctgctcggcagacaaagttggganatagaaatgctgcctggtattaccagaggccaggccagtcccctattttggcatcttcaagataagacgcgcctnaggactcctgaccgtatttctggctccactctaggaacncagccactcncgaccatcgacggccggggacccaggacccgaacggacgtaggaacgggagtaaccgttacgttacgttcggtacgacgggtccggtaaggggtaacgtaaacttacgttaagtttacgggttaagtttcgggttttacgggacgggtaagggaacccgtagggtaccgtcggtacccggttacgttacggtaccgaaccggtacccgaagggtcccgtacccgtcccccggtacggtaccctaccgttcccttaccggttacccccacccgttacccg

SEQ ID NO: 166978 - DNA, 633 bp, Homo sapiens
  misc_feature: GYAE6OF02I5YZK.26.71.G05.1.454.CMB.1.raw
  modified_base (239)..(239): a, c, t, g, unknown or other
  misc_feature (239)..(239): n is a, c, g, or t
  modified_base (335)..(335): a, c, t, g, unknown or other
  misc_feature (335)..(335): n is a, c, g, or t
  modified_base (369)..(369): a, c, t, g, unknown or other
  misc_feature (369)..(369): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggaccagacagccaccatcacctgctcggcagacaaagttggganatagaatgctgctgtataccagagcaggccacgtcccttatttcggcatctaccaagataagacgcggccctagaggactcccgtgaccgtattcncgcctacactcgtaggaacacacgcccacttccncgaccagtaccgacggtccgggaccccaacggacccgaaacggacgtacgggaagggtaacgtaaccgttaacgttacgttcggtacccgaggggtccggtagggtaacgttaaacttacgttagtttaggttacggtttggtttacggggacgggtagggacccgtaggtaccgtccgggaacccgttcgtacggtccgaacggtcccgaacggtcccgtccgtacccccgtggtccccacgttcccgtacccgttccccccg

SEQ ID NO: 166979 - DNA, 692 bp, Homo sapiens
  misc_feature: GYAE6OF02FP4WA.26.71.G05.1.454.CMB.1.raw
  modified_base (232)..(232): a, c, t, g, unknown or other
  misc_feature (232)..(232): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaattggganatagaatgctgcctggtattaccagacggccaggccacgtcccctattttggtcatcttcaagataagagcgcctnaggctcctgaccgtatttcngcctcactcgtggaacacacgccactctacgaccatcgacggccggggacccacggcccgaaacgggatacgggaacgggacgtaacgtaccgtttagttacggtacgtacggggtcggtagggtaagtaacgttacgtttaaggttcggtttaagggtttcgggttttacggggaccgggtaacggggtaaccgtaggggtccgttaccgggtacccgggttacccggttaacgggtacccgaacccgggtaaccccgggtaaacgggtcccggttaccccggtaccccccgggttacgggttacccctaacccggtttccccgttaccccggttttacccccgacccccgttttacccccgg

SEQ ID NO: 166980 - DNA, 633 bp, Homo sapiens
  misc_feature: GYAE6OF02GAM1C.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggggggcctcaggaagcagcatcgggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaagtgganatagaatgctgctggtataccagacgccaggccacgttccccttatttcggtacattccttaccaagagtaaacgaacggccggaccctcgacgggtactcccgtagaccgtaatttcgtaggcctaccgaacttcgtacggaacacgacgtcctactcgtacgacctagtcgacggccgggacccaaggacccaaacgggctagggaacggggtacgtactacttacgttacggtcgagggtacggtagggataaacgtacgttaagttggttaagttgggtttcgggacggtagtacggaccgtaggtctacgggtacccgttcgacgggtcaccggacccgtaacggtccgtccggtcccgttacggtccgtacctccttaccggtccctacccg

SEQ ID NO: 166981 - DNA, 635 bp, Homo sapiens
  misc_feature: GYAE6OF02HQ8FM.26.71.G05.1.454.CMB.1.raw
  modified_base (147)..(147): a, c, t, g, unknown or other
  misc_feature (147)..(147): n is a, c, g, or t
  modified_base (176)..(176): a, c, t, g, unknown or other
  misc_feature (176)..(176): n is a, c, g, or t
  modified_base (240)..(240): a, c, t, g, unknown or other
  misc_feature (240)..(240): n is a, c, g, or t
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
tcagagactatactcacgaccggtgctcgatttagtgtcgtcgcaagagagagggggggggcctcaggaagcagcatcggaggtgcctcagccatggcatggatccctctccttcctcggcgtccttgcttactgcacaggatccgnggccttgatgagctgattcagccaccctnagtcgtccgtgtccccaggacagacacgccaccatccacctgctcggacagaacaagttggganatagaatgctgcctggtattaccagacgaccagccacgtccctagtttgctatctacaanataagagcgcctagaggactacctagaccgtaatttcncgtactaccactcgtaacggacacgacgaccactcacgaaccacgtacgacggacccgggacccacggaacccgaacggaagtagggaacgggacgtaactaacgttagttacggtacgacgggttaccggtagggtaataaagttacttaagtttaggtaggtttaggttgggtacgggaacggacgtacggacgttacggaccgtaccgttaggaccgaacgtcccgaaggttcctacccgtcccccgttacggaccttaccgttcccgtccgtttaccccccgcccgttacccg

SEQ ID NO: 166982 - DNA, 757 bp, Homo sapiens
  misc_feature: GYAE6OF02HZ1JL.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtcttgcttactgcacaggatccgtggccttcgatgagctgattcagcccaccctgacgtgtccgtgtccccaggacagacacgccaccatcacctgctcggacagacaaattgggaanatagaaatgctgacctggtattaccgagacggccaggaccaccgttacccctttattttcgggtctatacctttaccgaaagactaaaggaacggtcccggacccttacggaacgggtccttaccccgtacggtaaacccgttaaacgttttccgtacgggtaccctaaccgtaacgttacggttaccgggaacctaaccgtaaccggccctaacgtcctaccggtaaccctacttaccgaccggaccccgggggtaccccacggaacccgaacgggacgtacgggacgggacgtaaccgtaccgttaagttacgggtacgtacgggtacgggtagggaacgttaaacgtactttagttagttacggtttaggtttcggggacggtacgggtaaccggtacggtacggtaccgtaccggttaccgtaacgggttaccgaacccgtaaccggtaacgtcccgttacccggcccccggttacggtacccgtaacccttccggttacccgttaccccccg

SEQ ID NO: 166983 - DNA, 683 bp, Homo sapiens
  misc_feature: GYAE6OF02GKM97.26.71.G05.1.454.CMB.1.raw
  modified_base (235)..(235): a, c, t, g, unknown or other
  misc_feature (235)..(235): n is a, c, g, or t
  modified_base (339)..(339): a, c, t, g, unknown or other
  misc_feature (339)..(339): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaatgctgcctggtattaccgagaggccaggccacgttccctagttttcggctattcttaccaaagtagtaagaacgccggccctcgacgggactccccgngtaccgtaatttcgtaggtcctacctaaccttcgtacggaaacctacgacgcccgaactccacgaccatccgacggccgggacccacgaccgaacggaacgtggacgggaacgactaacgttacgttcggtacgacgggtacggtagggaacggtaacttacgtagtttaggttaggtttggtttacgggacgggtagggtaacccgtaggtaccgttacgtaccggttcccggtaacgggtaccgaccggtaaccccgaaacgggtcccgttaacccggtcccccgttacgggttaccctacccgttaccggtttccccggttcccccgtccccgttaccccg

SEQ ID NO: 166984 - DNA, 561 bp, Homo sapiens
  misc_feature: GYAE6OF02FJ0Q1.26.71.G05.1.454.CMB.1.raw
  modified_base (401)..(401): a, c, t, g, unknown or other
  misc_feature (401)..(401): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggcatctccaagataagagcgccctacagggactcccgtgaccgtaattctggcctccaactcgtagggaacacacgacccactctcgaccatcaggccgggcccagcccgaacggntaggaagggatacgttactagttgacgaggtcgtgggataagtacgtagttgttagttgttcgggcggtaggaccgagggacctgaccggtccgtaacgggtccacggacccaaggcctaccgcccccgttcggtccaccttccgttcccgttacccccg

SEQ ID NO: 166985 - DNA, 700 bp, Homo sapiens
  misc_feature: GYAE6OF02GUH6Z.26.71.G05.1.454.CMB.1.raw
  modified_base (247)..(247): a, c, t, g, unknown or other
  misc_feature (247)..(247): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcagtcgtccgtcgtcccccaggacagacacgcccaccatccacctgcctcggcagaactaagttggganataagaaatgactgccgtggttacttaccagacggccgacggccacgttccccttagttttcggtctacttccttaccaagtataaggaacgccggtccctacgacgggtacctcccgtacgtacccgtaatttcgcggtcctacccgtaactcgtaacgggaacacgacgccctactcctacgaccacgtaccgacgggcccgggacccacggacccgaaacggacgtagggaacgggacgtaaccttacgtagttcgacgacgggtcgggtacgggaagtaacgttacgtttacgtttaggttaggttcgggtttacgggcggggtaacggaccgtaggtaccgttccgggtacccggttccggtaaccgggtccgaacccggaacccggtaccggtcccgtccccggtcccccgttccggtaccctccgttcccgttcccgttccccccg

SEQ ID NO: 166986 - DNA, 992 bp, Homo sapiens
  misc_feature: GYAE6OF02JN2DI.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacacgccaccatcacctgctcggcagactaaagttgggagaatagaaatgactgccgttggtacttacgaggacgaccgacggcctaccgttacccttagttttcggtaccttacgttccttaaccgaaacgtaactaaacgggacggcccgggtaccctacgggacggtaacctcccggtaacggtaacccgttacttttccggcggttacctacctaacgttcggtaacgggacctaagaccgtccgtaacttccgtaacgtaacccagtaccggacggggcccgggtacccaaccggtacccggaaaccgggttaggtaccgggggaaacggggtaaccgtaaaccggttaacgttaacggtttacggtaaccgggtaccgggttacggggtaaggggtaaacggttaaacgttaacggtttaacggtttacggggtttacgggtttaacgggttttacgggggaacggggggtaacggttaacccggggtaacgggttaccgggttaaccgggttacccggtttacccggggtaaccgggtttaccgggtaacccgggtaaccgggttaaacccgggttacccgggttacccccgggtccccccgggtttaaccgggttaccccggttaccccgggttttaccccgggtacccccgggttttaccccccccgggttacccggttttacccccggtaacccggttttaaacccgggttttaacccggtttacccgggttttaccccgggttacccgggttttaacccgggggtaacccgggggtttacccccgggggttaccggggttaaccccgggggg

SEQ ID NO: 166987 - DNA, 681 bp, Homo sapiens
  misc_feature: GYAE6OF02FXVPU.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggaccagacagccaccatcacctgctcggcagacaagttggganatagaaatgctgcctggtacttaccagaggccaggccacgtccccttagttttggcattccttaccgaacgtaataacgaagccgaccctcgagggactcccgtagaaccgtaatttccgcggtaccctaccgtaacgtacggtaacggaacctaacgcctacctactccgacgacctactacggacggacccgggcccgaacgaccgtaaccggagtacgggaacggaacgtaacgttacgtaggttcggtaaccggtagggtaccggtagggaaacgttaacgttaaccgttaggtttagttacgggttcggttacggggaccgggtacggaacggtacggtcgtacccggtaccgtaccgggttacggaccgaaccggtacccgaaggttcccgtaccccggtccggtaccgttaccgctttccgtcccgttaccccc

SEQ ID NO: 166988 - DNA, 851 bp, Homo sapiens
  misc_feature: GYAE6OF02H3HIW.26.71.G05.1.454.CMB.1.raw
  modified_base (246)..(246): a, c, t, g, unknown or other
  misc_feature (246)..(246): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggactccgtggccttcgatgagtctgattcagcccaccctcagtcgtccgtgtccccaggacagaccacgccaccatccacctgctcggacagaactaaagttcgggaanataagaaatgacgtgccgttaggtaacttaaccaggacggacccagggcccacggttccccttaattttcggtctacgttccttaccaaagtaataacggaacgacccggtccgtacgacggtactcccctaggaaccgttaatttccgtggtcctactaactcgtacgggaacaacgtacgaccctacgtctacgacctaagtccgaacggccccgggacccgtaccgaacccggaaaccgggtagtacgggaaacgggggtaaccgttaaccgttaaccgttaaggtttaccggggtacctaagggggtaccgggttaacgggggtaaagtaaaccgttaacgtttaacgggtttacggttttaaggttacggggtttttaaccgggggaaccggggtaaccgggggtaaaccgggtcgggtaacccggttaaccgggtacccccggtttaccgggtttaacccggggttaccccggaaccggggttaacccccggtaacggggtaccccgttttacccccggccccccgggtttacggttaccccgttaacccggtttcccccggtttccggtttccccccccgaaccctttttccccgggg

SEQ ID NO: 166989 - DNA, 848 bp, Homo sapiens
  misc_feature: GYAE6OF02JR8N7.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgcgtggtggacgcccacgcagaccctcacgctgacctgcctccgtctcgtggacttctctacctcaccacgactggaggtgaagtggtcggccgtcgggtccgtccgaccgggacccccgggaaacggcccgtagggtacggtcggtcttcggacctaccttaccgttacgtttaacggttgggtaaggttaggtaacgttaccgtacgaacggtaccggttaaaccgtaacgttcccggtaccttacgtacggtaacggtaacgtaccggtaacctacccaacccgtaacgtaaccgtaaccggaaccgggtaaccctaccccgtaaacccggtaaaccggggtaccccggggtttacgggttaacccctttaaccgtaaacggttacccggaaccccgtaacgtaacgttaaccggttaaaccgttcccgttaacggacggtaaaccgaccggtaacgggaccttaaacgtacgtttacgttaacgtcgtaccgacaaactaacgtacggttaccgtaacgggaccgtacgtaaccggaacgtaaacgaaaacgttaagtaccgttaggtaaccgtttacggggtaacgggtaacccgggttaagggtttaaccgtttacgggttacccgtaacccgttcccctaaccccgacggtaacccctacccggtaacccggtaacccggg

SEQ ID NO: 166990 - DNA, 671 bp, Homo sapiens
  misc_feature: GYAE6OF02H68K6.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccacatcacctgctcggcagacaaagtgganatagaatgctcgctgtatacgagacgcacggccacgtcccttatttcggtctatcttccaataataagacgcgcccgtcgacgggtactccgtacgtaccgtaacttctacggcctaccgactacgacggtaacacgacgcccaactcgtacgaccactacgacgggacccgggcccgacggtacccgaaacgggacgtacggagggaacgtaacttacttaaacgttcgtaccggacgggtcgggtacgggtaaggtaactttaaccgtaagttttaggttaggttaggggtttcggggacggggtaacgggaaccgtaacgggtccgttaccggtacccggtaccggttaacgggttacccgaacgggtacccgaaccggtccgacccgtcccccggtaccggtcccgtaacccttcccgtacccgttacccccg

SEQ ID NO: 166991 - DNA, 846 bp, Homo sapiens
  misc_feature: GYAE6OF02INTH2.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccacatccacctgctcggcagacaattggganatagaatgctgctggtacttaccagacggccaggccacgtccccttattttcgggctattccttaccaaggtaataaacggaacgtccggacccctacggaacggggtaccttccccgtacggtaaccgtaacgttttccgtcgggtacccttaccctaaccgttccgttacggggaaacaccgtaacgtccctaactccgtacggaaccctaacgtcccgaacggggccccgggggtaaccccaaccgggacccgaaacggggtaacgtacggggaacggggtaacgtaacccgtttaacgttaacggtttacggtaccggtaacggggtaccgggtaaggggaacgttaaacgttaaccggtttaaggtttacgggtttagggttttacgggtttacgggggaccggggttaaccggggggtaaacccgtacggggtacccgttacgggtaaccccgggttccggttaaccggggttacccgaacccggggtaacccccgggtaaacgggttcccgttaccccgggttacccccccggtttacgggttaccccttacccggtttaccccgtttaccccgggtttacccccctacccccgttttaccccgg

SEQ ID NO: 166992 - DNA, 555 bp, Homo sapiens
  misc_feature: GYAE6OF02JED8P.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaagtgganatagaatgctgctaggtacttacgagagccgagccacgtccctagtttgctatctacagataagagccggcctcgaggtactccgagacctaattctacggcctacaactcgtacggaaccacacgaccactccgtcgaacactacgacggtccggggacccacgacgaaccggtagcggacgggacgtacttacgtacgttgtcgaggcggtagggagtagtatagttgtagttggttggacggaggtacgagcgtacgccgtacgtcggtaccacgacccgaggtcctcgcccgtccgactcctccgtaccgttcccc

SEQ ID NO: 166993 - DNA, 803 bp, Homo sapiens
  misc_feature: GYAE6OF02GQ266.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaaagttgggagataagaatgctgcctaggtactaccgagaggccaggcccacgttccccttagttttcggtctacgttccttaccaaagtataacggaacgtcccggacccctacgacggggtacctaccccgtcggtaaaccctaagttttccgtacggtcccgttaccaaaccgttccgtaacggggaaacctaccgaccggaccctaaccgtttcctaccggaacccctacgttaccggaccgggaccccgggggtacccccaaacgggaccccggtaaacggggtaacgtacggggtaacggggaactaaccgtttaaccgttacgtttacggtaccggaacgggttccgggtaaggggtaacgtaaacgttaacgttaaggtttacggtttaggtttcggggttttacggggaccggggttaaccgggaaccggttacgggtaccggttaccgggttaacccggttcccggtttaacggtaccggaacccgtaccccgtaacggtcccgttacccgtccccccggtttacggtccccgtttaccgttccccgttaccccggtttacccccc

SEQ ID NO: 166994 - DNA, 751 bp, Homo sapiens
  misc_feature: GYAE6OF02HK3V0.26.71.G05.1.454.CMB.1.raw
  modified_base (243)..(243): a, c, t, g, unknown or other
  misc_feature (243)..(243): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtcctgcttactgcacgaggatccgtggccttcgatgagctgattcacgcccaccctcagtcgtccgtcgtccccaggacagacacgccaccatccacctgctcggcacgactaaagttggganatagaaatgctgcctggtacttaccagacggaccacggccacgtccccttattttcgggctacttccttaccaaagacttaaaggaacgccgggtccctacgtaacgggacctccccgtacggaaccgtaacgttttccacggtactacctaaccttcgtacgggaacaacgacgaccctaacctcgtacgtaaccctagtaccgaccgggacccggggtaccccaacggacccggtaaacgggacgtagggaacggggaactaaccgttaaccgttaagttcggtacgacgggtcggtaagggacgtaaacgttacgttaaggtttacgttagggttcggtttacggggacggggtaacgggtaaccggtacggtaccgtaggtaaccccggtaccgttaacgggtacccggaacgaccccggtaaacgggtcccgtaccccggtacccccgttccgggtacctacccgttcccgttacccggtttaccccctacccgtttaccccg

SEQ ID NO: 166995 - DNA, 709 bp, Homo sapiens
  misc_feature: GYAE6OF02GFBZE.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtataccagaggccaggccagtcccctatttcggcatccttccaagataagaagcgccctcgagggactcccgtgaccgtattctcggcctaccaactctagggaaccacgacgccctactcctacgaccctagtaccgacggcccgggggaccccacgggacccaaacggggacgttacgggaaacggggaacgtaaccgttaacgttacgtttacggtaccgtacggggtccgggtttaagggggaacgttaaagttaaccgtttaaggtttcggtttaaggtttgggtttttacggggaccgggtaacggggtacccgtaagggtaccgttacggtaacccggttacccggttaaagggtcccgtaacgggacccccgtaagggtccccgttacccggtccccccggttaccgggtaccccgtaccttacccgtttacccggtttaccccccc

SEQ ID NO: 166996 - DNA, 669 bp, Homo sapiens
  misc_feature: GYAE6OF02HDMD0.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaagttggganatagaaatgctgcctggtattaccgagacggccaggcccacgttccccttagttttcggtctattccttaccaagaataaagaacgccggaccctcgacggtactccgtcgaaccgtaattcgtcggcctaccaactcgtacgggaacacgacgcccactcgtacgacctagtccgacgggcccggggaccccaacggacccgaaacgggacgtaggggaacgggaacgtaaccgttaacgttagtttcggacggtacgggtacggtacgggtaacgtaacgttaacgttagttaggttaggtttcggtttacgggcgggtaacggaccgtaggtccgtacggtacccggttacgtacggtaccgacggacccgtaacggtcccgtacccggtccccgtcggtaccctaccgttccgttcccgttacccccg

SEQ ID NO: 166997 - DNA, 661 bp, Homo sapiens
  misc_feature: GYAE6OF02GITND.26.71.G05.1.454.CMB.1.raw
  modified_base (649)..(649): a, c, t, g, unknown or other
  misc_feature (649)..(649): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcgcagacaagttggagatagaatgctgcctggtattaccagagccagaccagtccctatttggcatcttacaagataaagagccggccctagagggactcccctaggtaacccgaattttccgtggtcctacccaaccttcgtacgggaaccacacgccaactcacgacccatccgacggccggggacccacggacccgaaacgggacgtacgggaacgggacgaacctacgttagttgtacgtagggccggtagggaagtaacgttacgttagttaggttagggttagtttcggggacgggtacgggtaacccgtagggtaccgttcgggaacccgttccggtacggtaccgaaccggtacccgaacgggtcccgtacccggtccccccggttacggtacccgtacccgtttcccgttaccggtttacccccnccccgttacccg

SEQ ID NO: 166998 - DNA, 611 bp, Homo sapiens
  misc_feature: GYAE6OF02GHPM4.26.71.G05.1.454.CMB.1.raw
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggagatagaaatgctgcctggtattaccagaggccagggccagtcccctattttggcatcttccaagataagagcggccctcgagggatccctgaccgtaatttcnggctccaactcgtgggaacncagccactcngacatcgacgccgggcccagacccgaacggagtacggagggacgacgttactagttcgtacgagggcggtagggaacgtaaagtaacgttagtttacggttaaggttcggttttacgggacgggtagggaaccgtacgggccgttacggacccggttcccgtaacggtccggaacggtacccgaacgggtaccctcccggcccccgttaccggtcccgtaccgttacccgtccgttaccccccg

SEQ ID NO: 166999 - DNA, 555 bp, Homo sapiens
  misc_feature: GYAE6OF02G62LG.26.71.G05.1.454.CMB.1.raw
  modified_base (206)..(206): a, c, t, g, unknown or other
  misc_feature (206)..(206): n is a, c, g, or t
  modified_base (402)..(402): a, c, t, g, unknown or other
  misc_feature (402)..(402): n is a, c, g, or t
tcagagactatactcacgaccggtgctcgatttagtgtcgtcgcaagagagaggggtccattccatggcatggatccctctcttcctcggcgtccttgcttactgcacaggatccgtggccttcgatgagctgattcagccaccctcagtgtccgtgtcccccaggacagacagccacatcacctgctcggcagacaaattggganatagaatgctgcctggtattaccagaggccaggccagtcccctattttggtcatcttccaagataagaagccggccctcagggactccctgacccgaatttctggcctccaactctgggaacacagccactctgaccatcgagccgggcccagaccaacggatggagggactactactattgtcaggcggtggganaagtactagttgtagttgtttggacggtaggaccaggcctaggaccgtcgtaggtccagcccgaaggcctcggccccctggtccacctcgttccgttaccccgcccttcctcctacgtactacgttcctcgtcgacggcgggtctggtaccgg

SEQ ID NO: 167000 - DNA, 884 bp, Homo sapiens
  misc_feature: GYAE6OF02FOCTO.26.71.G05.1.454.CMB.1.raw
  modified_base (190)..(190): a, c, t, g, unknown or other
  misc_feature (190)..(190): n is a, c, g, or t
tcagagactatactcacgaccggtgctcgatttagtgtcgtcgcaagagagaggggggggcctcggaggaagcgaggcatcggaggtgccgtcagccactggcatgggatccctctcttcctcggcgtccttgcttactgcacaggagtccgtggccttcgatggacgctacgattcacgccctaccctnacgtggtccgttgtaccccaggtacaagaccgacgacccaccacgtacaccttcgcctaccggacagaacaaagttcgggagataaggtaattgtacgtcgtccttggttaacttaccgtacggacggccgaacggcccaccgttacccccgttaacttttcggacctacttccttacctaaggtacgtacgaagtcccggtcccgtacgacgggtactccccgtaggtaacccgtaacgtttccgtcggtacccttaccgtaaccgttaccggtaccgggtaacctacgtaaaccgtcccttaaccgtacccggtaacccgacccgaaccgttacccgaccgggtaccccgggaccctacgggaccccggtaaaccggtacggtacgggtaacggggacggtacccgtaagtttacggttaccgtacggtaacgggtcggtacggggtactttaaacgttacgttagttacggtttacgtttacggggtttaccggtacgggggttaacggggtaacccggttaggggttaccccgttacgggaaccccggttacccggtttaaccgggtacccgtaaccgggtaccccggttaaacggggtccccgtacccgggttacccccgttcgggtttaccccgtaaccccgttttcccggtaccccgtttccccccgggttaccctttacccccggg

SEQ ID NO: 167001 - DNA, 647 bp, Homo sapiens
  misc_feature: GYAE6OF02HC7B9.26.71.G05.1.454.CMB.1.raw
  modified_base (175)..(175): a, c, t, g, unknown or other
  misc_feature (175)..(175): n is a, c, g, or t
  modified_base (232)..(232): a, c, t, g, unknown or other
  misc_feature (232)..(232): n is a, c, g, or t
  modified_base (641)..(647): a, c, t, g, unknown or other
  misc_feature (641)..(647): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcacctgctcggcagacaatggganatagaatgctgctggtataccagagccaggccagtccctatttggcatctacaagataagagcgcctcgagggactcccgtgaaccgtaatttccgtacggtcctacctaaccgtcgtaacggggaaacctacgaacgaccctaacgttaccgtacgaaccctagtccgaaccgggtacccggggaccccgaaccggaacccggaaaccggtaacgtacgggaacgggtaacggtaaccgtaacgttaacgttacgtacgtacgggtacggtacgggagtaaacgttaacgttaagttaggttacggtttaggtttacgggtacgggtaacgggtaaccggtacggtaccgttaccgtacccgggttaccgtacgggtaccggtaaccggtacccggtaacccggggtnnnnnnn

SEQ ID NO: 167002 - DNA, 569 bp, Homo sapiens
  misc_feature: GYAE6OF02FETTB.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagcccaccatcacctgcctcggcagacaaattggganatagaaatgctgcctggtataccagaggccaggccagtcccctattttggcatcttccaagataagaagccggccctcgagggactccccgtgaccgtaatttcctggcctccaaccttccgtagggtaaaccacgacgcccactctagacccatccacggcggggaccccagacccgaacggagtggagggagaccgtactacttgtacgaggtcgtgggagaatacgtattggttagtggtttggcgggtagggaccaggctcgaccgtctaggtcgacgcccaacggctcgcccccgtggtccaccgtctccgttcccacccttacccg

SEQ ID NO: 167003 - DNA, 756 bp, Homo sapiens
  misc_feature: GYAE6OF02JWAVW.26.71.G05.1.454.CMB.1.raw
  modified_base (735)..(735): a, c, t, g, unknown or other
  misc_feature (735)..(735): n is a, c, g, or t
tcagagactatactcacgaccggtgctcgatttagtgtcgtcgcaagagagaggggcgtgggcctcacggaagcagcatcggaggtgcctcagccatggcatggatccctctcttcctcgcgtccttgcttactgcacaggagtccgtcggccttcgatgagctgtattcagccaccctcagtgtccgtcgtccccagacagaccacgccaccactccaccttgcctcggcacgacaaagttcgggataagaataaacgtgtcgtgtaccgtggtaacttaccgaaggacggaccgacggtccgaccgttccccctttaaggttttccgtctacttcccttaccgtaaacgtactaaacggtacgaccgtcccgttaccgaggggtacctccgtacgtccgtaaagttcctacgggtctacccgaacgttcgttacggaacgaacaccgtaccgtaacctccgggacctaccgacttaccgacggccgggccccgaaccgcccgaaacggtacgaacggacggacgtaccgttacgtacgttacgttcggaacggtccggtaagggtaacttaaccggtaagtttaaggtttaccgtttaagggtttcgggttcggggtaacggggtaccgggttaacggtaccgggaccgttaccggaccggttaccgtaacgggttccgtacggtccccggtaacggtccgttcccggaccccggttaccggtcccgttaacnccggtttacccggttcccccg

SEQ ID NO: 167004 - DNA, 676 bp, Homo sapiens
  misc_feature: GYAE6OF02F810Z.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatccacctgctcggcagacaaagttggganatagaatgctgctaggtattaccgagacggccgaggccacgttccccttagttttcggtctacgttccttacccaaaggtaataaaggaacggccggccctacgacgggtactccccgtagaacccgtaatttccgtggtaccctccaaccttcgtacggaacaccgacgcccactccgtacgaaccctataccgacggcccgggtcccaacggacccgaaacggtacgtagggaacgggacgtaacctacgttagttcgacgaggtacggtagggagtaacttacgttaagttggttaggtttggttacgggacgggtacgggtaacgacgggtcgtacggtacccgttacgtacggtaccgacggtacccgacggtcccgtacccggtccccttcgggtcctaccgtttcccgttacccggtcccctccccttcccg

SEQ ID NO: 167005 - DNA, 749 bp, Homo sapiens
  misc_feature: GYAE6OF02JO9YL.26.71.G05.1.454.CMB.1.raw
  modified_base (242)..(242): a, c, t, g, unknown or other
  misc_feature (242)..(242): n is a, c, g, or t
  modified_base (624)..(624): a, c, t, g, unknown or other
  misc_feature (624)..(624): n is a, c, g, or t
tcagagactatactcacgaccggtgctcgatttagtgtcgtcgcaagagagagggggcgtgggcctcaggaagcagcatcggaggtgcctcagccatggcatggatccctctcttcctcggccgtccttgcttactgcacaggatccgtggccttcgatgagctgattcagcccaccctcagtcgtccgtcgtcccccgaggacagaccagccaccatccacctgctcgcagacaagtgganatagaatgactgccgtaggttacttaccgagtaggccgacggccctacgtaccccttagttttcggtcctacgttccttacccgaagtaactaagaacggtacccggcccctacgaacggggtaccttcccggtacggtaaccgtacgtttaccgtcgggtacctacccgtaaacgtccggtaacgggtaaaccaccgtaacgtacccacgttacccgtacgacctacgtccgaacgggtccccggggaacccctaccggacccgtaaacggacgtaacgggacgggaacgtaaccgttaacgttacgttacggtaccgtacggggtaggtacgggtaagtaacgttacgtaacggtttagttacgggtttaggttacgggngggtaaccgggtacgtacggcgttaccgggacctttcgggaacgggtttccaacgggtccccggaggtaccccgttcccggaccccgttccggtaccttaccggtcccgttaccccggtaccccc

SEQ ID NO: 167006 - DNA, 667 bp, Homo sapiens
  misc_feature: GYAE6OF02JDB2J.26.71.G05.1.454.CMB.1.raw
  modified_base (237)..(237): a, c, t, g, unknown or other
  misc_feature (237)..(237): n is a, c, g, or t
  modified_base (327)..(327): a, c, t, g, unknown or other
  misc_feature (327)..(327): n is a, c, g, or t
  modified_base (359)..(359): a, c, t, g, unknown or other
  misc_feature (359)..(359): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatccacctgctcggcagacaaagtggganatagaatgctgccgtagtacttaccagacgccgagccacgtccctagtttcggtctactctacaagataagacgcgcctgacggctccgngaccgtattcgcgctccaactcgtacggaacncaacgcctactctacgacctacgtccgacgggtccgggaccctacggaacccgtaacggagtacgggaacggggactaccgttaacgtacgttacgtacggacgggtcggtagggtaactaagttaaccgttagttttacgggttaggtttagggttacggggaaggtacgggaaaccgttacgggtaccgttacggtacccggtaccggtaacgggtacccgtaaccgggacccgtaaccgggtccctacccggttccccgttacccggtaccgtacccggtttacccgttcccgttaacccccccg

SEQ ID NO: 167007 - DNA, 536 bp, Homo sapiens
  misc_feature: GYAE6OF02F39UU.26.71.G05.1.454.CMB.1.raw
  modified_base (214)..(214): a, c, t, g, unknown or other
  misc_feature (214)..(214): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
  modified_base (467)..(467): a, c, t, g, unknown or other
  misc_feature (467)..(467): n is a, c, g, or t
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgcctccgtctctggatttcncactcaccacgactgagtgaatgtggccgtgggtccgtcaggcccccgtaaggccctggagtggtcttgcactcactttacnggagtgagtctcgaagcggtaacaatccgtctctgagatcgactcaccatcaacgacggacacctaccgaaagccgggtagtcctaacgatcgacganagtagaatcctagtggacacgagcacatattacgtgtacgcactacacgtcagcgctacgacaagaaacgtanatagactacgttgggactaagggtacttttggacctaccgtctccccaggtccctacgaccgtaaccgg

SEQ ID NO: 167008 - DNA, 739 bp, Homo sapiens
  misc_feature: GYAE6OF02FW5JK.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccacatcacctgctcggcagacaaattgganatagaaatgctgcctggtattaccagaggccaggccagtcccctagttttcggcatcttccaagtataagaacgcggccctgacgggactcccgtagaccggtaattttccgtcggccttacccaaactccgttagggaaaccacgacggtaccccacgttccacggtaacccattacccggacggacccgggggaccccaacggccccgtaaaacgggtacgttacgggaacgggggaacgtaaccgtttaacccgttaagtttcggtaaccgaacggggtaccgggtttacgggggaaacgttaaacgttaacggttaacgtttgggtttaaacggtttagggttttaccggggacgggtaaacggggtacccgtaagggtaccggttacggtaccccggttacccgttaaggggtacctaacccgggaccccgtaagggtccccttaccgggccccccgtttagggtaccctaacccgttccggttacccgtttaacccccccg

SEQ ID NO: 167009 - DNA, 609 bp, Homo sapiens
  misc_feature: GYAE6OF02GL21K.26.71.G05.1.454.CMB.1.raw
  modified_base (128)..(128): a, c, t, g, unknown or other
  misc_feature (128)..(128): n is a, c, g, or t
  modified_base (236)..(236): a, c, t, g, unknown or other
  misc_feature (236)..(236): n is a, c, g, or t
  modified_base (358)..(358): a, c, t, g, unknown or other
  misc_feature (358)..(358): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgnttactgcacaggatccgtggccttcgatgagctgattcagccaccctcagtgtccgtgtccccaggacagacagccaccatcacctgctcggcagacaaagttggganatagaaatgctgcctggtattaccagaggccaggccagtcccctatttggcatctccaagataagagcgccctgagggactcccgtgaccgtaactttctggctaccaactcgtagggaacncgacgccactctacgaccatcgacggccgggacccaggacccgaaacgggatacgggaagggacgtacctacgtagttcgtacgagggcggtaggaacgtaagtacttagttaggttagttggtttcgggacggtacgggaaccgtaggtcgtacggaccgtccgtacggtccgaacggacccgtaacgggtccgtcccgtccccgttacggtccgtaccgttccgttacccgttcccctaccgttacccg

SEQ ID NO: 167010 - DNA, 707 bp, Homo sapiens
  misc_feature: GYAE6OF02ID277.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtgtccgtcgtccccaggaccagacagccaccatccactgactcggacagacaaagttggganactagaaatgactgcctaggtacttacgagacgccagcctaacgtccccttattttcggtcattccgttacaacgaagtaagacgcccggacctacgaagggaccttacccgtacgaccggttaatttccgtcggtacctaccaaacgtcgtacgggtaaccaacgtacgcctaacctacgtacgaccacgtccgaaggccccgggaccacgaccgaaacgggagtaacggtagggaactacgttaaccgttaagttcgttaccgaacgggtcggtaagggtaactaaacggtttaacgttacgttttagggtaaggttttcgggtttaacggggacgggttaacggggaactagggtacccgttaggtaacccggttacggtaaccggttacgaaccggttacccgaaggtcccgtacccgtaccccggtaccggtaccctaacgttccccgtaccttacccccgg

SEQ ID NO: 167011 - DNA, 669 bp, Homo sapiens
  misc_feature: GYAE6OF02HBXMQ.26.71.G05.1.454.CMB.1.raw
tcagagactatactcacgaccggtgctcgatttagtgtcgtcgcaagagagaggggcgtggctcaggagcagcatcggaggtgcctcagccatggcatggatccctctcttcctcggcgtccttgcttactgcacaggatccgtggccttcgatgagctgattcagccaccctcagtgtccgtgtccccaggacagacagccaccatcactgctcggcagacaaattgggagatagaatgctgcctgtattacagagcaggccagtcccctatttcggtctatcttccaagataagaacgcggccttcgacgggtaactccctcgaaccgtaatttcctggtactccgtaactcgtacggaacacgaacgcctacgtctagacccatcccgagccggggtacccacggacccaacgggacgtggaaacgggacgtaacttaaccgttagttacggtgtaaccggtacggagggtaagtaaaccgttaagttacgttaggtttagttagggttttacgggacgggtaaacgggccgtaacggtccgttacgggtacccggttaccgttaacggggttaccgtaacgggtaccccggaaacggtcccgttaccggttccccccgggtaaggttccccgtaacccggtttcctccccggtttaaccccccgg

SEQ ID NO: 167012 - DNA, 562 bp, Homo sapiens
  misc_feature: GYAE6OF02FOZWO.26.71.G05.1.454.CMB.1.raw
  modified_base (237)..(237): a, c, t, g, unknown or other
  misc_feature (237)..(237): n is a, c, g, or t
  modified_base (340)..(340): a, c, t, g, unknown or other
  misc_feature (340)..(340): n is a, c, g, or t
  modified_base (548)..(548): a, c, t, g, unknown or other
  misc_feature (548)..(548): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagcccaccatcacctgctcggcagacaagttggganatagaaatgctgcctggtattaccagaggccaggccagtcccctattttggtcatctacaagataagaacgcggccctcgaggctcccgtgaccgtaatttcncggtactccaactcgtagggaacacagcccactctacgacctactacgacggccggggcccacgcccgaaacggataggagggaacgactaacgtattcggacgaggcgtgggagtaatacgttagttgtaggttgtttgggacgggaggaccgagcgtcggaccgtcgtacggccgacgacccgaagcctcggccccgttcggtccnccgtctcttacccc

SEQ ID NO: 167013 - DNA, 678 bp, Homo sapiens
  misc_feature: GYAE6OF02JE2EC.26.71.G05.1.454.CMB.1.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccacctcagtgtccgtgtccccaggacagacagccaaccntcacctgctcggcagacaaagttggganatagaatgactgcgtaggtactacggagtacgacgacggcctacggtccccttaggtttccgatacttaccttaccgaagtactaaagaacgtaccggtaccctagggacgtactccgtacgaaccgttattaccgagtcctactactcggtacggaacacgacacctactcgacacctatacgagggtacccggaccacggaaccgaaacggtacgtaacgggaacggtacgaacgttaacgtagttacgtacgtacggtacggtaacgggaactaacggtaacttaacggttacgtaaggtttacggttacgggacgggtaacggaccggtacgggtaccgtacgggtaccgtacggtaacggtacgtaccggtaaccgaacggtaccgtaccggtaccccgtaggtacccgtaccgttaccgtacccggttaccccg

SEQ ID NO: 167014 - DNA, 839 bp, Homo sapiens
  misc_feature: GYAE6OF02H2PXB.26.71.G05.1.454.CMB.1.raw
  modified_base (179)..(179): a, c, t, g, unknown or other
  misc_feature (179)..(179): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (513)..(513): a, c, t, g, unknown or other
  misc_feature (513)..(513): n is a, c, g, or t
tcagagactatactcacgaccggtgctcgatttagtgtcgtcgcaagagagaggggggcctcaggaagcagcatcggaggtgcctcagccatggcatggactccctctcttcctcggcgtccttcgcttactgacacgaggacttccggtggtccttcgagtgagtctgattcacgccnccctcagtcgtcccgtagtccccgaaggaccagacgaccgtccaaccatccaccgtggtcctcggacaacgaactaaagttcggganataacgaatcgtcgngtaccgtaggtacttaaccgnggaccggacctacggacctacgttaccccgtttagttttcggccctaagtttccctacgtaaacgtaagtaacggtaacgcccggtccctaggtaaaccgggtccttaccccggtaggtaaccgtaacgttttccggaccgtccgtaaacccgtaagtcccgtaaagggaaacctccgtaaccgacccgttccttaaacgtccgtaaaacnccgttaccggacgggacccggacccgtaacgtaacccgacggtaacggttacgggaacggttaccgtaaacgtttaccgtaactttacggtacccggtaggggttacccgtaggggttaaacgttaacccgtttaacgggttaaccgttaggttttaaccgggttttacgggttcgggaacgggttccgggaacgtacggtaccggtaacgttacccgaggttacccgtacggtaaccgggtcccgtaaccgggtcctaaccccggtccccgtacgggttacctacccggtttaccgtaccccggttccccggtacccttacccgg

SEQ ID NO: 167015 - DNA, 794 bp, Homo sapiens
  misc_feature: GYAE6OF02GZXHO.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaagtggganatagaatgctgcctggtacttaccaggacggccaggccagtccccttagttttcggtcctattccttaccaaagtaacgtaaaggaacggccggtaccctacggacgggtacctccccgtacggaaccgttaactttcgtcggtacctacccgtaaccttaccggtacgggtaaaccaacgaacgtacccctaacgttccgtacgaaccctaacgttaccggaacgggtcccggggtaccccaacgggtaaccccgaaaccgggtacgtaacggggaacggggtaacgtaaaccgttaacgttaagttttcggtaccgtaaggggtaccgggttaagggggaacgtaaacgttaacgttaaggtttacgggttaagggttttgggtttacggggtaccggggtaagggtaacccggtaagggtccgttacgggtaacccggttccggtaacgggttacccgacgggtaacccgaacggggtcccgtaccccgggtcccccgttaccgggttcccgtacccgtttacccggttacccgtttaccccccgtaccccgttaccccg

SEQ ID NO: 167016 - DNA, 663 bp, Homo sapiens
  misc_feature: GYAE6OF02FRYRK.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataaagagcggccctcgagggactcccgtgaccgaatttcgtggctccaactctacggaacacacgcctactctcgaacccatccgacggccggggccccaacggacccgaacgggatacgggaacggggaacgaccgtaacgttagttggtaccgagggtcggtaggggagtaaacgtacgttaagttggttagttgggttttagggaccggggtagggtaacccgtacgggtacgttcgggacccggttccgtaacgggtaccgaaccggtacccgtaaaccgggccgtttacccggccccccggttccggtacccttcccgttacccgttacccggtttccccccgtacccctttacccccgg

SEQ ID NO: 167017 - DNA, 682 bp, Homo sapiens
  misc_feature: GYAE6OF02JWQZE.26.71.G05.1.454.CMB.1.raw
  modified_base (244)..(244): a, c, t, g, unknown or other
  misc_feature (244)..(244): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcgagtgtcccgtgtcccccaggaccagacacgcccaccatccaccgtgcctcggcagacaaagttggganatagaatgctgctgtattaccagacgccaggccagtccccttagtttcgtacattctaccgaagtataaggacgcgtccgtacacgggtactacccgtcggtaaccgttaactttcgtacggtcctaccgtaaccgttgtaaccgggacaacggacgtacccacgttaccgacgtacccatcccgacgggacccggacccgtacggaccgaacgtcgtaggaaccgggtatacccgtaagttacgttagaccggtaggcggttaggaacggtaaacttacgttagttacgtaggtttcgggttacgggacgggtaaccgtacgtacggcgttacggtaccgtccggtaggtaccgacggtacccaggtaccccgtaccgtaccccggttcggtacccgaaccgtttcccgttaccgtcccccgttaaccccgttccgg

SEQ ID NO: 167018 - DNA, 704 bp, Homo sapiens
  misc_feature: GYAE6OF02F65LC.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtacttaccgaggacggccaggccacgttccccttaagttttcggtctattccttaccgaagtaataaagaacgccggaccctcgaagggtactcccgtagaaccgtaactttcgtcggcctaccaacgtcgtaacgggaaccacgacgacccactcctacgaccacgtacgacgggacccggggaccccaacggacccgaaacgggtacgtacgggaacgggtacgtaaccgttaacgttagttacggtacgtacgggtacggtacgggaacgttaaacgttaacgttaagtttacggtttaggttacgggttttacggggacgggtaacgggtacgtacgggtaccgtacggtacccgttaccggtacgggtaccgtacggacccgtaacggtcccgtaccggtcccccgttacggtacccgtaccgttcccgttacccgttacccccg

SEQ ID NO: 167019 - DNA, 568 bp, Homo sapiens
  misc_feature: GYAE6OF02F1QEM.26.71.G05.1.454.CMB.1.raw
  modified_base (434)..(434): a, c, t, g, unknown or other
  misc_feature (434)..(434): n is a, c, g, or t
tcagagactatactcacgaccggtgctcgatttagtgtcgtcgcaagagagaggggggactcctgtgccccaccatggacacgctttgctccacgctcctgctgctgaccatccccttcatgggtcttgtcccagatcaccttgaaggagtctggtcctgcgctggtggagcccacgcagaccctcacgctgacctgctccgtctctgattctcactcaccagactgaggtgaatgtggccgtgggtccgtcacggcccccggaaaggccctggagtggcttgcactcatttacgtggtagtgatctacgaagccggtacaactccgtctctagaggaatcgactcaccatcacgaggaccactaccaagaccgggtgtacctacatacgaccgacatgtaatcctggtagacacaggccaactattattactntacgcacacgacgtccgtaggccggtactacggacgaaagaaacgaatatagacttaggttcggggacctaaggggtaagtttttcgaccgtaccgttccgtaccccgtagccccgtccgaacccgtaaccggg

SEQ ID NO: 167020 - DNA, 595 bp, Homo sapiens
  misc_feature: GYAE6OF02H1R4B.26.71.G05.1.454.CMB.1.raw
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtcttgcttactgcacaggatccgtgccttcgatgagctgattcagccaccctcagttcgtccgtcgtccccaggacagacacgccacatcactgctcggcagactaattgganatagaatgctgctgataccagngccagccacgtcccttatttcggtcatcttacaagataagacgcgcctgaggactccngtactattcngctacaactgtacggacacacncctactcncgacctagtcgacggcccggggaccaacggaccgaaacggacgtacgggaacgggtactaaccttaacgttacgttacggtaccgaacgggtcggtaagggtaactaaacgttaacgttacgtttaggttacggttggtttcgggacgggtacggaccgtaggcgtacgtaccgtccgtaggtaccgacggtacccgaggtccctaccgccccgttacgcctacgttccctcgttaccccc

SEQ ID NO: 167021 - DNA, 758 bp, Homo sapiens
  misc_feature: GYAE6OF02GKOKS.26.71.G05.1.454.CMB.1.raw
  modified_base (461)..(461): a, c, t, g, unknown or other
  misc_feature (461)..(461): n is a, c, g, or t
tcagagactatactcacgaccggtgctcgatttagtgtcgtcgcaagagagaggggtccattccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaatcgctgccgtggtacttaccgagacggccacggccacgtccccttattttcggtctattccttaccaagtaagtaaaggaacgccggcccctacggaacgggtactccccgtacggtaaccgtaattttccgtcggtacctacccgtaaaccgttccggtacggggtaaaccaccgaacgtcccaccgttacctacgaaccctacgttccgaccgggccggggaccccgaacggtacccgaaacgggtntacggggaacgggtaacgtaaccgttaacgttaacgttcgtacggtaacgggtcgggtaggggtaaacgtaaacgtacgtttaagttacggttaggtttgggtttaggggacgggtaacgggtccgaagggtcgttaccgggaacccggttccgtaacggtccgtaacggcccgtaagggtcccttacccggacccccggttcggtaccccgtaccgtccgttcccgttcccccgcccttcccgttactacgttacgtacgttccgtcgttacggacggtccgggacgtcggtacgg

SEQ ID NO: 167022 - DNA, 530 bp, Homo sapiens
  misc_feature: GYAE6OF02GQ2D7.26.71.G05.1.454.CMB.1.raw
  modified_base (465)..(465): a, c, t, g, unknown or other
  misc_feature (465)..(465): n is a, c, g, or t
tcagagactatactcacgaccggtgctcgatttagtgtcgtcgcaagagagaggggagtgactcctgtgccccaccatggacacgctttgctccacgctccctgctgctgaccatccccttcatgggtcttgtcccagatcaccttgaaggagtctggtcctgcgctggtggagcccacgccagaccctcacgctgacctgctccgtctctggattctcactcaccacgactgacggtgaatgtggcctgggtccgtcaggccccccggaaaggcccctggagtggcttggcactcatttactggagtgatctcaagcggtacaatccgtctctgaggaatcgactcaccatcacagggacacctcaaagaccggtcgtacctacaatgaccgacatagaatcctgtcgacacgaggcacatacttactgtgcacacagtccaggcgactacgcgaagaaagtanatgaactatttgggggaccctagggtaattttggtactacccgtacctcccgacgtcctaccccg

SEQ ID NO: 167023 - DNA, 749 bp, Homo sapiens
  misc_feature: GYAE6OF02GYJW0.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaagttggganatagaatgctgctggtatacagacgcaggccacgtcccctagtttcggcatcttaccaagataagacgcgtccctcgagggtctcccgtagaaccgtaatttccgtcggtacctacctaacttcggtacgggaacacgacgccctactctacgacctagtccgacggtcccgggaccctacgggacccgaaacgggtcgtacgggaacgggtacgaaccgtttacgtacgtttacggtccggtaacgggtccgggttaaggggaaacgttaacgttaaccgttaaggtttacgggtttaacggtttaggggttttaccgggggcggggttaacggggtaacccggtaacgggttaccggttacgggtaccccggtttacccggttaaccgggtaccggtaacccgggtaaccccgtaacggggtccccgttacccggttacccccccggttaaggttccccgtaacccggtttcccggtttacccccggtttaccccccctaccccgtttaccccgg

SEQ ID NO: 167024 - DNA, 743 bp, Homo sapiens
  misc_feature: GYAE6OF02FT0JQ.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacagccaccatccacctgctcggcagacaaagttggagatagaaatgctgcctggtacttaccgagacggccacggcccacgtccccttattttggtcctacgttccttaccgaagtaataacgaaacgccggtccctacgaaggggactcccgtcgaaccgtaacttttcgtcggtcctacccgtaactccgttacgggaacctaacgacgcccgtaactccgtacgacccgtactaccggacggtaccccgggggaccccacggaacccggtaaaccgggaacgtaccggggaaaggggtaaccttaaaccgttaccgttaaacggtttccgtaccggaaaggggtccggttaccggggaaagttaaccgtaacgtttaacggtttagttaaagggtttcgggtttagggtaccggggacgggaaccgtacgggtccgttaccgacccggttccgttaacggtccaaccggacccggtaacggtcccggtcccggtaccccgtccggttaccaacccgtttccgtccggtacccccccgg

SEQ ID NO: 167025 - DNA, 628 bp, Homo sapiens
  misc_feature: GYAE6OF02I1NGG.26.71.G05.1.454.CMB.1.raw
  modified_base (180)..(180): a, c, t, g, unknown or other
  misc_feature (180)..(180): n is a, c, g, or t
  modified_base (238)..(238): a, c, t, g, unknown or other
  misc_feature (238)..(238): n is a, c, g, or t
  modified_base (292)..(292): a, c, t, g, unknown or other
  misc_feature (292)..(292): n is a, c, g, or t
  modified_base (449)..(449): a, c, t, g, unknown or other
  misc_feature (449)..(449): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgttccttgcttactgcacaggactccgtggcctttcgatgagctgattcagccaccctnagtgtccgtgtcccaggacagacagccacagtcacctgctcggcagacaagttggganatagaatgctgcctggtatacaggagcaggccagtccctattgtcatctcaganagagcgcctcgaggtctcctgaccgtaattcgtaggctacaactcgtagggtaacacgtacgccactctcgaccaactcgaacggtccggggacccacggcccgaaacggactagggaacgggaacgtacgttaacgtaacgtttgtacgtaacggnggtagggaagtaaacttacgttagtttaggtagtttgggtttacggtacggggaacggtaccgagggtcgtacggtaccgttaccgtaacgggttacgaccggtaacccgtaacggtccccgtacggtacccccgttccgggttaccctaccggtttacccgtccctttaaccccccgg

SEQ ID NO: 167026 - DNA, 626 bp, Homo sapiens
  misc_feature: GYAE6OF02IR04C.26.71.G05.1.454.CMB.1.raw
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (381)..(381): a, c, t, g, unknown or other
  misc_feature (381)..(381): n is a, c, g, or t
tcagagactatactcacgaccggtgctcgatttagtgtcgtcgcaagagagaggggcgtgggcctcaggagcagcatcggaggtgcctcagccatggcatggatccctctcttcctcggcgtccttgcttactgcacaggatccgtggcctttcgatgagctgattcagcccaccctcagtcgtccgtcgtccccaggacagacacgccaccatcacctgctcgcagactaagtggganatanaatgacngctgtatacgagacggcacgccacgtcccttagttttcggtctatcctaccaagtaactaagaacgccggtcctagacggactccgtcgaccgttattcgtcgtcctacctactcgtacgggaacacgacnccactctaccgacactccggacggccggaccgacgaccgaacggtagacggacggacgtaacttacgtagtcgtacgtacggtcggaggagtaacttagttacgttaggttacggttggttacgggacgggacggtaaccgtacggtcgttaccggccgttaccggtaggtaccgaccggtacccggacggtcccgtcccggaccccggttacggaccttacccggtaccgttcccgtacccccg

SEQ ID NO: 167027 - DNA, 815 bp, Homo sapiens
  misc_feature: GYAE6OF02GJOHP.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtgagcccacgcagaccctcacgctgacctgctccgtctctggattctcactcaccacgactgaggtnaatgtcggcctgggtccgtcgacggcccccgaaaggccctggagtggcttgctactctagtttaccgtggagtgattccgtacgaaggtccggtaactaacgttcccgttacttaccgtaggaaggtaaccttccggaaccttaccgaacctacttacccgaacccggtaacggggaaccctaacccgtaaccgaaaacgggtacccggggtttcggttacccctttaactaaacgttacggaaacccgtaacgtaacgttacgtaaaccttcccggttaggtaccgggtaaaccaaccggtacgggacctaaaccgtagttttaaacgttaccgtggttacgtaccaaaccgtacgtaacccgggttcctaacgggtacccggggtaccttaaccgggaacgggtaaaacggtaaaaacgaacttaacggttacggtaaccgtttaacgggttaccggggggtaaacccttaaggggggttttaaaccgttttttcgggaacccgttaaccccgggttttaccccgttacccccggaacccggtttacccccgtaaccccgtaacccgggtaaaccccgggg

SEQ ID NO: 167028 - DNA, 775 bp, Homo sapiens
  misc_feature: GYAE6OF02FKXRX.26.71.G05.1.454.CMB.1.raw
  modified_base (177)..(177): a, c, t, g, unknown or other
  misc_feature (177)..(177): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatccacctgctcggcagacaaagttgggagatagaatgctgcctggtattaccgagaggccacggccacgttccccgttattttcggtactattccttaccgaagtaagtaacgaacggtccggacccctacgaacggggtactccccgtacggtaacccgtaacgtttccgtcggtaccctaccgtaaccgttacgtacgggaaacctaaccgaacgtacccctaacttacccgtacgtaacccgtaacgtacccggtaaccgggtccggggggttaaccccaacgggaccccgtaaaacgggacgttacgggaacggggtacgtaaaccgttaacgttacgtttacggtaacgtacggggtacggtacggggtaagtaaacgttaccgtttaagtttaggtttacggtttaggtttacggggaccgggtaaacgggtaccgtacgggtcgttaccgggtaccggttccggtaaacgggtccgtaacccgggacccgtaacggtcccgttacccggtacccccggtaccggttaccacccgtttccggttccccggttacccccgg

SEQ ID NO: 167029 - DNA, 727 bp, Homo sapiens
  misc_feature: GYAE6OF02GCXLF.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccaccatcacctgctcggcagacaaagttgggagatagaatgctgcgtggtattaccagaggccaggccacgtcccctatttggcatcttccaagataagaacgcgcctcagggactcccgtgaccgtattccgtggctaccactcgtagggaacacgactccactctacgacccagtccacgggccgggcccaacggacccgaaacggtgtaggaacgggagtaacctacgttaagttcggtccgtaacgggtccgggtagggaacggtaaaacgtttacgttaacggtttaggttagggtttcggggtttttaacggggaccggggttaacgggggtaacccggtaggggtacccggttaccgggtaacccgggtttacccggttaacggggtttaccggaaccgggttaaccccggaaaccggggttcccgttaccccgggtacccccccggtttacggggtaccccttacccggtttaccccgtttccccgggtttacccccccgtccccggtttacccccgg

SEQ ID NO: 167030 - DNA, 672 bp, Homo sapiens
  misc_feature: GYAE6OF02IIIWE.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcacgccaccctcagtgtccgtgtccccaggacagacagccaccatcacctgctcggcagacaaattgganatagaaatgctgctggtattaccagaggccaggccagtccccttatttcggctatccttacaagataaagagccggcctcgaggtactccctgaccgtaattctggctaccaacgtctagggaacacgacgacctactctacgacctacgtacacgggccgggaccctacggaacccggaacgggaacgtacgggaacggggtaacgtaaccttaacgttacgttcggtacgacgggtacggtagggaagtaaacttagttaacgtttaggttaggttcgggtttagggacgggtacgggaaccgtagggtccgttacggtacccggtccggttaacggtccgaaccggtaccccgaacgggtcccgtacccggtacccccggttccggtaccgttacccgttcccgtttcccgttaccccccgtacccttaccccgg

SEQ ID NO: 167031 - DNA, 632 bp, Homo sapiens
  misc_feature: GYAE6OF02G0TVA.26.71.G05.1.454.CMB.1.raw
  modified_base (470)..(470): a, c, t, g, unknown or other
  misc_feature (470)..(470): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtcgtcccccaggacagacagcccaccatccacctgcctcggcagaactaaagttgggagataagaaatgctgcctagtattacagagccgagccacgtccccttagtttggcacttcttccaagataagaacgccgccctacgagggactccgcgtaacgtacttcgtcggcctaccgtaactcgtacgggaacaccgcgtaccctctactacgtaccactccgacgggccgggcccacgaccgacggagtaggacgggacgtactacgttacgttcgtacggnggtcggaggtagtaagtacgttagtttagtaggttaggttacgggacgggacggtaccggaggtccggtacgtacccgtacggtacggtacgtaccggacccgtaacggtccggtacccgtcccccgttcggtacccgtccgtccgttcccgttaccccccg

SEQ ID NO: 167032 - DNA, 732 bp, Homo sapiens
  misc_feature: GYAE6OF02FKEH6.26.71.G05.1.454.CMB.1.raw
  modified_base (232)..(232): a, c, t, g, unknown or other
  misc_feature (232)..(232): n is a, c, g, or t
  modified_base (337)..(337): a, c, t, g, unknown or other
  misc_feature (337)..(337): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaatgganatagaatgctgcctggtattaccagagccaggccagtcccctattttggcatcttccaagataaggaagcggccctcgagggactcccgtgaccgtaattttcgnggtcctccaaacttcgtagggaaccacgacgaccctactccttcgaccagttaccgacggcccggggaccccaagggtaccccgaaacgggtagtacgggaacgggggaacgtaaccgttaaccgttaacgtttcggtaccggtaaggggtaccggttaggggaaacgtaacgtttaacgttaagtttagggttacggtttgggttttaggggaccggggtaacggggtaacccgtaggggtaccgtaccgggtaacccggtttcccggtaacgggttacccgaaccggtacccccgtaaacggggtccccgtttaccggaccccccccgtttacgggttacccctaacccgtttcccgttacccgttttaccccccgaccccgttttacccccg

SEQ ID NO: 167033 - DNA, 854 bp, Homo sapiens
  misc_feature: GYAE6OF02GV7YJ.26.71.G05.1.454.CMB.1.raw
tcagagactatactcacgaccggtgctcgatttagtgtcgtcgcaagagagaggggcgtgggcctcaggagcagcatcgggaggtgcctcacgccatggcatggacttcccctctcttccctcggcgttccttgccttactgccacgaggatccgtggccttcgatgagctgacttcagtccctaccccttgacgttcggtacccggtacgtaccccccgagggaccacggtaccacgccccaaccgactccaacccttggccgttccgggacaacgtaacctaaaaggtttgggggaatagtaagaaatagactcggtacccgttagggtacttaccccgaaggtaccggtacccacgggtaccctacggtttaccccccgttaagttttcgggtacctaacgttaccgttacccgaacgtacgtaacggtaacggcccggtacccgtacgacgggtacttcccgtacggaaccgttacgttacgtcgggtacctaccgtaaccgttcgtacgggtaacctaaccaccggtaccctaccttcgaaccgtaccctagttaacccgaccgggtcccggggtaacccctaccgggtacccgtaaacccgggtaagtaccgggtaacgggacctaaccgttacgtaacgttcggaccggtacgggtccggtacgggtaagtaaacgttacgttacggttacggttacggtttcggttacggggaccggggtaaggtaacccgaagggttccgtacgggtacccgtaccggtacggtaccgaccggtcccggaacggtcccgtacccggttccccgttaccggttaccgtcccgtttaccgtcccgtttacccccccg

SEQ ID NO: 167034 - DNA, 597 bp, Homo sapiens
  misc_feature: GYAE6OF02HHRO9.26.71.G05.1.454.CMB.1.raw
  modified_base (234)..(234): a, c, t, g, unknown or other
  misc_feature (234)..(234): n is a, c, g, or t
  modified_base (349)..(349): a, c, t, g, unknown or other
  misc_feature (349)..(349): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganataagaaatgctgcctggtataccgagacgccaggccagtcccctattttggctatcttaccaagtataaggaacgcggacccttcgagggactcccgtagaccgtaatttccgnggcctccgtaacctcgtacggaaacaccacgcctactctcgaaccatcgacggccgggcccagccgaacggatacggaggngactactagttcgngacggtcgaggagtagtactagttcgtaggttcgttagggcggtacggaccgtaggcgtacgtaccgtccgttagtccggtaccgaccgaacggtccgtacccgtcccccgtcggtacctaccgttccgtacccggttcccgtcccttacccg

SEQ ID NO: 167035 - DNA, 592 bp, Homo sapiens
  misc_feature: GYAE6OF02HDJIR.26.71.G05.1.454.CMB.1.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccagccagtccctatttgcatcttccaagataagagcggcctgaggactccngaccgtattcngctaccatcgtggaacacacgccactcagaccatcgacggccgggacccagacccgaacggataggaagggactactaactagttcgcgagggtcggtagggaagtaagttacgtagttgtaggttggtttgggacggagggaccaggcgtacggaccgtaccgtacggtcacggacccgaggtcctcccggtaccccgtacggtcctaccgttccgttccggttcccccgtcccttcccgttacgtaaccgttacgttacgttcctacgttcggacggtccgggtctacggg

SEQ ID NO: 167036 - DNA, 691 bp, Homo sapiens
  misc_feature: GYAE6OF02IVY5P.26.71.G05.1.454.CMB.1.raw
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttgatgagctgattcagcccacctgagtgtccgtcgccccaggacagacncgccacatccacctgctcggcagacaagtgganatanaatgcngccgtgtactaccgagacggccacggcctacgttacccctttagtttcggtactacttaccgttaccaaggtactaaagacgttcggcccgtacccgtcggacgggtaccttcccgtacgtaccgttaacgtttcgcggtaccttacccgtacgtcggtacgggaaccacgtaccgacctcttccgtacgaccgacgtccggaccgggacccgggacccgacggaaccgtaacgggagtacgggacggtaagtaacttacgttagttcgtacgacgggtagggtacgaagtacgttacgttagttaacgggttaggtttacgggttacgggacgggtaaccgggtacggtcggtacggtaccgtacccggtaggtaccggttacggcgtaacggcccggtaggttcccgtacccggttccccgtacggttccgtacccttccccgg

SEQ ID NO: 167037 - DNA, 752 bp, Homo sapiens
  misc_feature: GYAE6OF02I5M20.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaaatgctgcctggtattaccagacggccaggccacgtccccttattttcggtactatccttaccaagtataaagaacggccggccccgtacggggactccccgtggaacccgtaatttccgtcggcctaccaacttccgtggggaaaccacgagccctactcgtcgaccctagtccgtacgggcccggggtaccccaacggtaccccgaaacgggagtacggggaacggggaacgtaaccgttaacgtaacgtttcgggtaccgtacgggtacgggttggggaaaacgtaaagtaaccgtttagtttacgggttaacggtttagggtttaccggggacggggtaacgggggacccgtaaggggtcccgttaacggtaccccggttaccgtacgggttcccgtaaccgggaccccggtaaacgggtacccgttcccgggtaccccccggtttcggtaccctacccggtttcccgtttaccccggttacccccgtacccccgtttcccgttaacccg

SEQ ID NO: 167038 - DNA, 707 bp, Homo sapiens
  misc_feature: GYAE6OF02JH6Q0.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgttccgtgtccccaggacagacagccacatcacctgctcggcagacaagttggganatagaatgctagcctaggtattaccagaggcaggccctagtccccttagtttggtcagttcctccgaagactaagaacgccggtccctgacggggtactccctgaccgtaattccgtcggcctaccgaacgtcgtacgggaaacaccgtacggacccacgtccgtacgtacccacgtaccgacgggcccgggggtaccccaacggacccgtaaacgggacgtacgggacgggtaacgtaccttaacgttagttacggtaccgacgggtaccggtggggtaactaacgttacgttacgtttaggtacggttttaggtttacggggaccgggttaacgggaacccgtacgggtaccgttcgggtaaccccggttacggttacggttaccgaaccgggtacccgtaacggtcccgttccggtaccccccgttcgggtaccctacccggttccgttacccggtttacccccccgg

SEQ ID NO: 167039 - DNA, 730 bp, Homo sapiens
  misc_feature: GYAE6OF02HSM7W.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaaatggganatagaaatgactgcctggtattaccgagaggccaggccacgtcccctattttggctatcttaccaagataagaacgcggccctcgaagggactcccgtgaaccgtatttcgcggtctaccgaactcgtaggaaccacgacgaccactctacgacccatccgacgggcccggggacccacggacccgaaacgggtacgtacgggaacggggaacgtaaccgttaaccgttaagtttacggtacggacggggttccgggtaacggggaagtaaacgttaacgttaagttttagggtaggtttaggtttaggggaccgggtaaggggtaaccccggtaggaccggttaccgggtacccggttacccggttaacgggacccgtaaacgggtaccccccggtaaagggtccccgttaaccccggtcccccccgttacgggttacccctaaccggtttcccccgtttaccggtttacccccccgtaccccgttaacccccg

SEQ ID NO: 167040 - DNA, 638 bp, Homo sapiens
  misc_feature: GYAE6OF02HQGSO.26.71.G05.1.454.CMB.1.raw
  modified_base (311)..(311): a, c, t, g, unknown or other
  misc_feature (311)..(311): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagagccaggccagtcccctagtttgtcatcttcaagataagaagcgcctnagggactcccgtgacctattcgtgcctacaactcgtaggaacacacgaccatcctacgaccactccgacgtcccggggacccacgacccgaacggacgtaggaacgggagaccgtaacttagttcgtacgaggcggtacgggaagtaaacgttacgtacgtttagtaaggttcggtttacgggtacgggtagggtaaccgagggtaccgtacggtacccgttaccggttaacggtacccgtaaccggcccgtaaaccgggtccgtacccggtaccccccggttaccggttacccgtaacccgttcccgttcccggtttaccccccgg

SEQ ID NO: 167041 - DNA, 786 bp, Homo sapiens
  misc_feature: GYAE6OF02HO5VM.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggcccttcgatgagctgattcacgcccaccctcagtcgtccgtcgtccccaggacagacagcccaccatccacctgcctcggacacgaacaaagttgggatatagaatgctgcctaggtacttaccgagacggccaggccctacgttaccccttagttttcggtacctacttccttaccaaagtaacttaaaggaaaccggccggtacccccgtacggaagggtaccttaccccgtacggtaacccgttaacgttttccgcggtaccttacccgtaaacctccggttaacgggaaaccctaaccggaacgtacccgtaaaccttcctaaccggaaccctaacgttacccgaacgggtccccgggggaccctaacgggaaccccgaaacgggtacgtacggggaaacgggaccgtaaccttaacgttagttaccggtacgacgggtacgggtaacgggacgtaacgttaacttaggtttaggttaacgtttcgggtttacgggacggggtaaaccgggtccggtaacgggtccgtaccgtacccgggtacctacgggttacccgaacggacccggtacggtcccgtacccggtccccgttccggtacctaccgttccgttacccgttcccgtaccccttccg

SEQ ID NO: 167042 - DNA, 797 bp, Homo sapiens
  misc_feature: GYAE6OF02GFZEA.26.71.G05.1.454.CMB.1.raw
tcagagactatactcacgaccggtgctcgatttagtgtcgtcgcaagagagagggggagtgactcctgtgccccaccatggacacgctttgctccacgctcctgctgctgaccatcccttcatgggtcttgtcccagatcaccttgaaggagtctggtcctgcgctgggtggacgcccacgcacgaccctcacgctgacctgcctccgtctcgtggacttctacactccaaccacgacgtaggaggtagaagtggtacggccgtcgggtaccacgtaccggaaccgggaccccccggaaacggtccccgtaggggtacggtcgggtcttcggacctaccgttacttaacgttttaaccggtagggtaacgttagtacgttaccgtaccgaaacggtaccggtaaacctaacgttcccgttccgttacgtaggaaacggtaacgtaccggtacctaaccgaaccgtaactacccgaacggaacgggaaccctaacccgtaaccggaaaacgggttacccggggttacgttaacccgttaacgtaaacgtaccggtaaacccggtactaacgttacgtaaacttccgtaggtacggaacgtaaccgacggtaacctaacgtaactttaacgttacgtacgtacgtaccaacgtacgtaccgttaccgtacggtaccgtaccgtaacgaaccgaaaagtaaagtaacgtaagtacgtaacgtttacgggtaacgggaacggttagggtttaacgtttacggtacccgtacccgttacccgtacccgtacgtaacccccgg

SEQ ID NO: 167043 - DNA, 651 bp, Homo sapiens
  misc_feature: GYAE6OF02JLJF2.26.71.G05.1.454.CMB.1.raw
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
  modified_base (361)..(361): a, c, t, g, unknown or other
  misc_feature (361)..(361): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgttccgtcgtccccaggacagacagccaccacncacctgctcggcagaacaatggagatagaatgctcgctagtataccagngccagccacgtccctatttggtcacttcctaccaagtactaagacgccgcctcgaggtctcccgagaccgtatttcgtcggtactacccaacgtcgacggaacnctacgccctactcgtacgacctagtcgacggtaccgggcccaaccgaccgaacggacgtagggtaacgggaactaccgtagttaccgttaggtacccggaggggtccgtaggggtaataaccgttactaagggtttagtttagggttaggtttcggggaacgggaaccggtaccgagggtccgtacgtacccgggttcgtaggtccgaacggtacccgaaagggtcctcccggtcccccgttacgggttcctaccgtttcccggtcccctttaccccgccccttacccgg

SEQ ID NO: 167044 - DNA, 669 bp, Homo sapiens
  misc_feature: GYAE6OF02IVE8F.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacacgccaccatcacctgctcggcagacaaagtgganataagaatgctgctggtattaccgagacgcaggccacgtcccctagttttcggcattctacaagataagacgcgacctgacggctccgtgaaccgtaattcgtacggtcctaccgaacgtcgtacggaacacgacgccactctacgaccatccgacggccgggacccacggacccgaaacgggagtagggaacgggtaacgtaaccgttaacgttacgttacggtacgagggtacggtaggggaaacgtaacttaacgtttagttaggttacggtttagggtttcggggaacggggtaacgggaacccgtacgggtccgtacgggtacccggttaccggtaacgggtaccgaccggtaccccggaacgggtcccgtacccggtcccccggttacggtaccctaccggtttcccgttcccggttaccccccg

SEQ ID NO: 167045 - DNA, 754 bp, Homo sapiens
  misc_feature: GYAE6OF02JF9IR.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtcgtccgtgtccccaggacagacagccacatcacctgctcgcagactaaagttggacgatagaatcgctgcctaggtacttaccagacgccaggccacgttcccctaagttttcggactacgtcgttaccgaagtagtaaacggaacgtccgggtacccctacgaggggacttacccgtaggtaacccgtaatttccgtacggaccttacccgtaacgttaccgtaggggaaacccaccgtaacggtccctaacgttccgtacggtaacccgtacgttacccgaaccgggtccccggggaaccccacgggaacccgtaacgggtacgtacgggtaacgggaacgtaccgttaacttacgttacgtaccggtaagggtccggtagggaacgtaaacgttaccgttagtttacgtaacggttcggtttacgggaccgggtaacgggtaaccgtacgggtaccttacgggtacccgtccggttaacgggtaccgtaacgggtaacccgtaacgggtacccttacccggtacccccggttacggttacccgtaaccgttccgttacccggttccccccgg

SEQ ID NO: 167046 - DNA, 746 bp, Homo sapiens
  misc_feature: GYAE6OF02G3YHS.26.71.G05.1.454.CMB.1.raw
  modified_base (218)..(218): a, c, t, g, unknown or other
  misc_feature (218)..(218): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgctttactgcacaggactccgtggtccttcgatgagtctggtattcacgcccaccctctacgttcgtcccgtcgtccccgaggacacgacncgacccacactccaccgtcgccgtcggcaacgaactaaaggttgggaataagtaagaactgactgtaccgttagttaacttaccgaggacggccgaacggtccctaccgttcccttaggtttcgactacttcctaccgaaagtaactaacggaacggtcccgtacctacggtacgggtaccctcccgtaacgtaacccgttaagtttccggagtaccctaccgtaacgtcggtaacggaaacctccgaaccgtacctaccgtacctaacgtaacctacgtacgaccggggaccccgggacccacggaacccggaaggtacgtaggggaccgtaacgtaacgttacgttacgttacgacggacggtcggagggtaacttaaagtagttgtttaggttaggttcgggttgggacgggtaacggtcggtacgcgttaccgggtaccttacgggttaacgccgtaacggacccgtacgggtccctaccccgggtccccgtacggtcctacccgttcgttacccggtcccccg

SEQ ID NO: 167047 - DNA, 653 bp, Homo sapiens
  misc_feature: GYAE6OF02GCT0Q.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgcctcggcagacaaattggganatagaatgctgcctggtacttaccagaggccaggccacgtcccctagttttcggtctattccttaccaagtataaagaacgccggccctcgaggtactcccgtagaccgtaattcgtggcctaccaactcgtagggaacacgacgccactcctacgaccataccgacggcccgggacccaggaccccgaaacggagtacgggaagggacgtaaccgttaacgttacgtttcggtacgaacgggtcggtaggggaacgtaaacgttacgttaagtttagttagggtttaggtttacgggacgggtacgggaccgagggtccgtacggtacccgttccggtaacggtaccgaccggtacccgaaggtcccgtccggtcccccgtcgggtacctacccgttcccggtccgttcccccgg

SEQ ID NO: 167048 - DNA, 785 bp, Homo sapiens
  misc_feature: GYAE6OF02FUFF8.26.71.G05.1.454.CMB.1.raw
  modified_base (241)..(241): a, c, t, g, unknown or other
  misc_feature (241)..(241): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccacctcagtcgtccgtgtccccaggacagacacgccaccatccacctgcctcggcagacaaagttggganatagaaatcgactcgcctaggttaacttaccgaggtacggccgacggcctacggttaccccttaagttttcggactattaccttaccgaaagtacaaaggaacgtcccggacccgtagacggggtccttcccgagtaaccgtatttccgacggtcctaccaacgttaccggtacgggaaaccacgtacgtaccccgtactaccgttacgaaccctacgtaaccggaccggggtaccccgggggaccctaaccgggaaccccggaaacggggtaccgtaagggggaaccgggtaacgtaacctttaccggttaacgtttcgggtaccgtaacgggggttccggtaaacgggggtaacgttaaacgttaccgttagttttaaggggttacggtttaggggttaccggggaacgggtaacggttaacccggtacgttaaccggtacgtacccggttacggtaacggtaccgaccggtaacccggtaacggcccggttcccggtaccccgtccgggtaccgtccgtttacccggtacccgttcccccg

SEQ ID NO: 167049 - DNA, 775 bp, Homo sapiens
  misc_feature: GYAE6OF02F5GNY.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagcccacatcacctgctcggcagacaaagtggganatagaatgctgcctggtaattaccgagacggaccaggacctacgtccccttagttttcggtactacttccttaccaaaggtaataaaacggaacggccggacccctacgaacggggactaccccgtagtaacccggtaaacttttccgtacgggtccccttaacccgtaaaccgttccggtaacggggaaaccctaaccgacgtacccctaacttccgaacgaaccctacgtacccggaacgggcccgggggtaccccgaaacggaccccgaaacggggtacgtagggaacgggggtaactaaccgttaacgttagtttacggacgtaacggggtccggtaggggaacgttaaagttaacgttaggtttacggttaacgggttgggtttaccggggtaaccgggaggggtaacccgagggttccgtacggtaccccggttaccggtaacggttaccgaccggtaacccgtaacggtcccgtaccccgtcccccgttaccgggttacccaacccggtttccgtacccgtttacccccccg

SEQ ID NO: 167050 - DNA, 710 bp, Homo sapiens
  misc_feature: GYAE6OF02GYISJ.26.71.G05.1.454.CMB.1.raw
  modified_base (232)..(232): a, c, t, g, unknown or other
  misc_feature (232)..(232): n is a, c, g, or t
  modified_base (332)..(332): a, c, t, g, unknown or other
  misc_feature (332)..(332): n is a, c, g, or t
tcagagactatactcacgaccggtgctcgatttagtgtcgtcgcaagagagaggggggggcctcaggaagcagcatcggaggtgcctcagacatggcatggatccctctcttcctcggcgtccttgcttactgcacaggatccgtggccttcgatgagctgattcagccaccctcagtgtccgtgtccccaggacagacagccacatcacctgctcggcagacaaatggganatagaaatgctgcctggtataccagaggccaggccagtcccctatttggcatcttccaagataagacgcgcctcgagggactccctagaccgtaatttcncggtcctccactcgtacggaacacggaccactctcgaccatacgacggccgggacccagaaccccgaaagggcgtagggaacgggacgtaaccgttaacgttaacgtttacgggtacgaacggggtcgggttaggggaagtaaacgtttaacttaagtttacgggttaacggtttggggttttaacggggcggggtaaacggggtaacccggtaacgggtaccggttaccgggtaacccggttacccgtttacggggttaccgtaaccgggtaaccccggaaccggtccggtacccgggtacccccccgttaccgggttacccctaccggtttccccttaccgggtttcccccccgtcccgttaccccgttaacccgg

SEQ ID NO: 167051 - DNA, 672 bp, Homo sapiens
  misc_feature: GYAE6OF02FQ7PG.26.71.G05.1.454.CMB.1.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatccacctgctcggcagacaaagttggganatagaaatgctgcctggtattaccagaggccaggccagtcccctattttggcatcttccaagataagaagcgcctnaggggctccngacctaattcnggctaccaactcgtagggaacacgacgcccactctacgacctatcgacggtccggggaccccaggacccgaaacgggactacgggaacggggacgtaacccttaacgtacgtttacggtaccacggggtacggttaggggaagtaaacgttaacgttagtttaggttacgggtttgggttttacggggacgggtaacggggtaacccgagggtaccggttcggaacccggttcccgttaacgggtaccgaaccgggtacccccggtaaaggtcccgtacccggtaccccccggttcgggtaccccgtaccttcccggttacccgttaccccccccg

SEQ ID NO: 167052 - DNA, 788 bp, Homo sapiens
  misc_feature: GYAE6OF02HU4PP.26.71.G05.1.454.CMB.1.raw
  modified_base (439)..(439): a, c, t, g, unknown or other
  misc_feature (439)..(439): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctagattcagcccacctcagttcgtccgtcgtccccaggacagacacgccactatcctacctgctacggcaagactaagttggagtaactaagaatgactggcctaggtactacgaggtcggccacggcctacgttccccttagttttcggtactacgttccttaccgaaagtaacgtaaacggacggtcccggtacccgtacgaacgggtcctaccgttacgaacccgttagtttccgcgtacctacccgtaacgttcggtaacggaaccaacgtaccnccgtactaccggtcaaccgtacgtaccgacgggtacccgggccgacgtaaccggaacggtacgtacgggaacggtactaaccgttaacgttacgtcggttacgtagggtacggtacgggtaagttaacgttaacgtttacgttagggtttaacgggttacgggtttacggggtaaccgggtacgggtaccggtaccgggttaccggttaccgggtacccggtttaccggttaacccgggtaccgtacccgggttaaccccggtaacccgggttcccgtaccccgggttcccccggtacccgggtttacccgtttaccccggttcccgtttaccccggtttaccccccgg

SEQ ID NO: 167053 - DNA, 681 bp, Homo sapiens
  misc_feature: GYAE6OF02GFOLW.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagaacaaattggganatagaaatgctgcctggtattaccagaggcaggccagtcccctattttggtcatcttaccaagactaagaagccggccctcgacgggtactccccgttagacccggtaaatttcgtacgggtcctaccaaccttcgtagggaaccactagacccactctagaccagtccacggccggggccccaacggaacccgaacggtacgtacgggaaggggaacgtaaccgttaacttaagtttcggtacgacgggcgtaggggaagttaacgtaacgttaatttacggttaaggtttggtttacggggacggggtaagggacccgtagggtaccgttacgaccgggttacctaaggggttccgaacggtacccgaacggtcccgtccgtaccccccggttccggtaccgtacccgttaccgttcccggttaccccccggtacccttaccccg

SEQ ID NO: 167054 - DNA, 868 bp, Homo sapiens
  misc_feature: GYAE6OF02FK5XC.26.71.G05.1.454.CMB.1.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcacgcccaccctcagtgtccgtcgtccccaggacagacacgccaccatcacctgcctcggcagaacaagttgggaanataagaatgctcnccgtagtattaccgaggacggccaggccctacgttcccctttagttttcggtacctattccttaaccgaaagtaacgtaaacggaacggcccggtaccccgtacggtaacggggtaccttccccgttaaccggtaacccggtttaactttccggtacggtacccttaaccgtaaccgttccggtaacggggaaacccaccgtaaccgtcccctaaccttccgtaccgaaccctaagtaccccggacgggtacccccgggaacccgaaccggaccccggtaaaccgggtacggtaaccggggaaacggggtaacgttaaccgttaaaccgtttaaggtttacggtaccggtaacgggggtcggtaacggggaacgttaaacggttaacgtttaaggtttacgggttacggtttagggttttacggggaccggggttacgggtaacccggtaccgggttaccggtaccggttacccggttaccgttacgggtacccgtaaccgggtacccggttaaccggtacccggttaccccggttccccccgttaccgggttaccccgttaccggtttaccccggtttacccccgttacccccgttaccccccgttacccggg

SEQ ID NO: 167055 - DNA, 632 bp, Homo sapiens
  misc_feature: GYAE6OF02GABGK.26.71.G05.1.454.CMB.1.raw
  modified_base (176)..(176): a, c, t, g, unknown or other
  misc_feature (176)..(176): n is a, c, g, or t
  modified_base (235)..(235): a, c, t, g, unknown or other
  misc_feature (235)..(235): n is a, c, g, or t
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctnagtgtccgtgtccccaggacagacagccaccatcacctgctcggcagacaagttggganatagaaatgctagccttggtacttaccgagacggccaggccagtccccttatttcggcatctaccaagataagagcggccngacggactccctgaccgtattcnggctaccaactcgacggaacncacgaccactcagacccataccgacggccgggacccagacccgaacggagtagggagggaactacgtacttagttcgacgagggtcgtagggaataacgttattacgttaggttacgttggtttacgggacggtaacgggtaaccgacgggtacgtaccgtacccggttaccgttaacggtccgaacccggaccgtaacggcccggttacccgttcccccgtacggttaccctaccggtttccttacccggttacccccgtcccttaccccg

SEQ ID NO: 167056 - DNA, 795 bp, Homo sapiens
  misc_feature: GYAE6OF02IZ6YF.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaattgggagatagaaatgcgtgcctggtattaccgagacggccaggccacgtccccttagttttcggtacctattcgttaccgaagtaactaaaggaacgaccggtcccgtacgagggacctacccgttacggaaccgtaacttttccgtacggtccgtaaccctaaccgttacgtacgggaaactaaccgacgtacccaccgttcgtaccgacctacgtaccgtaccgggacccggggtacccgaacgaaccccggaaacgggaacgttacgggaaacggggtacgtaaacccgttaaccgttaagtttaccgggtaccgttacggggacggttacggggaaagtaaacgtttaaccgttaaagtttcggtttaaggttcgggttttaacgggacggggtaaccggggtaaccgacgggttaccgtaccgggttacccggttacccggtttaacgggtaccggtaaccggaccccggtaaacggggtcccgttaccccggtacccccggttacccgggttcccggttaacccttcccggtttacccggtttacccccccgtacccgttaccccg

SEQ ID NO: 167057 - DNA, 854 bp, Homo sapiens
  misc_feature: GYAE6OF02JWLEH.26.71.G05.1.454.CMB.1.raw
  modified_base (105)..(105): a, c, t, g, unknown or other
  misc_feature (105)..(105): n is a, c, g, or t
tcagagactatactcacgaccggtgctcgatttagtgtcgtcgcaagagagagggggctgggcctcaggaagcagcatcggaggtgcctcagccatggcatgganccctctcttcctcggccgtccttgcttactgcacaggatccgtggcccttcgatgagctgattcagcccaccctcagttcgtcccgtgtccccgaggaccagacacggccaccacttaccacctgccgtccggaccacgaacgaaagttgggacgaagtaagaacgtcgactcggcctaggttacttaaccgaggacggaccacggtacccgacgttccccttagtttacggtcacttccgttaacccgtaaaggactaaaggaccggtacccggtaccccgtacgaacgggggtacctacccgttaacggaaccccgttaagttttacctccgggtacccttacccgtaacgtttaccggacgggaaaaccctccgaaaccgtccctaaccgtccgttaaccgtaacctacccgtcccgggtaaacggtccccggggtaacccccgaaccgggacccggaaaccgggtacggtacgggtaaccgggaaaccgtaacctttaacggtttacgtaccggttcccggaaaggggtacccgggtaaggggaaaccgttaaccggttaacgtttagtttacgggttaacggtttacggggttttaccggggacggggttaaacgggcccgtaagggttccctacccggtacgggttacccgtaacgggttacccaccgggtaacccgtaggtccctacccgggttccccgtaccggttccgaacccgggtttccttcccccgggttacccccg

SEQ ID NO: 167058 - DNA, 724 bp, Homo sapiens
  misc_feature: GYAE6OF02I34XK.26.71.G05.1.454.CMB.1.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtcgtccgtcgtccccaggacagacacgccaccatccacctgcctcggcagacaagttggganagtanaaatgctgcctggtataccagaggccaggccagtccccttattttggtctatcttaccaagtagtaagaagccggcctcaggactccctgaaccgtaattcgtgtccacctaactcgtacgggaacaccgacacccgtactccgtacgacctactcgacggccggggtacccacggacccgaacgggaactaggggaacgggtaacgtaaccgttaacgttacgtttacgtccggtaacggggtccggtaggggtaacgttaaacgttaacgtttaggtttaccggggtttaggtttcggggtttacggggtaccggggtaaacggggtaacccggtagggggtaccgttaccgggtaaccccgggtttcccgttaacggggttaccggaccggtaaccccgtaacggggtcccgtaccccgggtccccccgttacccgggtaccctcccggtttacccgttcccggtttaaccccccg

SEQ ID NO: 167059 - DNA, 868 bp, Homo sapiens
  misc_feature: GYAE6OF02JEXID.26.71.G05.1.454.CMB.1.raw
  modified_base (175)..(175): a, c, t, g, unknown or other
  misc_feature (175)..(175): n is a, c, g, or t
  modified_base (236)..(236): a, c, t, g, unknown or other
  misc_feature (236)..(236): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagcccaccatcacctgctcggcagacaaagttggganataagaatgcgtgcctaggtattaaccgagagggtcccacggcctaggttccccttagttttcgggtactacttccgttacaaacgtagtaaacggaacgtccggaccctcggtaaggggacttccccggtaaggaacccgttaattttccgtcgggacccttacccggtaaaccttcggtacggggaaaccctaaccgaaccggtaccctaacttcccgtaacggaacccctaaggttaccggaacccgggggtccccgggggtaacccccgtaacggaacccccgggtaaacggggtaacggttaacgggaaaccggggggaaacttaaaccccggttaaacggtttaaaccgttacgggttaacccggtaaggggggtaccggggtaacgggggttaaacggtaaaccgtttaaaaccggtttaaggtttacggtttaagggttttaggggttttacgggggtaggggtaaccgggttaccgggtaaacgggtccgttaaccggtacccggttaccggttaaccggtacggtaaaccgggacccgtaaaccgggtccctcccgggttaccccccgtcgggttaccctaccggttcccgttaccgggttcccccctcccgttaaccccgg

SEQ ID NO: 167060 - DNA, 661 bp, Homo sapiens
  misc_feature: GYAE6OF02H1G25.26.71.G05.1.454.CMB.1.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaattggganatagaactgcngctgtatacagagcaggccagtccctatttcgctatcttacaagtactaagacgcgtcctgaggtactccgtagaaccgtactttcgtcggtactaccgtaactcgtacggaactacacgacctactctacgactacgtacgacggccggggacccctaacggacccgaaacgggatacgggagggaaccgtacgtaacgtagttcggtaccgacgggtaccggtagggtaacgtaaacgttaaccgttagttacgggtagtttcgggttacgggacgggttacggggaaccgtaggaccgttacggaacccgttcggtaacgggttccgacggaacccggtacggtcccgttacccgccccggtttaccggacccttccgttacccggttacccggttcccccgtacccgttccccg

SEQ ID NO: 167061 - DNA, 719 bp, Homo sapiens
  misc_feature: GYAE6OF02G6NXN.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccaccatcacctgctcggcagacaagtggganatagaatgctgcctggtactaccgagacggccaggccacgttccccttagttttcggtcctacttccgttaccaaagtaataaacgaacggccgtaccctacgaagggtacctccccggtacgtaacccgtaacttttcgtcggtacccttaccgtaaccgttcgtaacgggaaacctaacgacgtaccctacctccgtacgaaccctagtaccgacgggcccgggaccccacggaccccgaacgggacgtaggaacgggactaaccgttacgttagttcgtacggagggtcggtaaggggtaataaagttacgttaaggtttaggtaggtttgggtttacggggacgggtaacgggtaacggacggtacctacgggtacccgttacggtacggtaccgaaccggtacccgaaccgggttccctacccggtcccccgttcggtacccttaccgttcccggttcccgttccccgtccccttacccg

SEQ ID NO: 167062 - DNA, 704 bp, Homo sapiens
  misc_feature: GYAE6OF02HOFQY.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccaccatcacctgctcggcagacaagttgggagatagaatgctgcctggtattaccagacggccaggccacgtccccttatttcggtcatccttaccaagataagacgccggccctacgagggactcccgtgaccgtaatttccgtggcctaccaacttcgtacgggaaacacgacgccctactcctacgaaccctagtaccgacgggacccggggtaccccacggaaccccggaaacggacgtagggaacggggacgtaaccttaacgttacgtttacggtaccggaggggtacgggtagggaataacgttaacgttagtttagggtaggtttcggttacggggaccgggttaacgggaacccgtagggtaccgttacgggtacccggttaccgtacgggtaccgtaaccgggaccccgtaaacgggtcccgttacccgggccccccgttaccggtccgtacccgttccggtttccccggttacccccgtccccttaccccgg

SEQ ID NO: 167063 - DNA, 845 bp, Homo sapiens
  misc_feature: GYAE6OF02JEXJI.26.71.G05.1.454.CMB.1.raw
  modified_base (241)..(241): a, c, t, g, unknown or other
  misc_feature (241)..(241): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacagccacattcacctgctcggcagaacaaagttggganaagtagaaatcgctacgcctaggtacttaacgacggtacggacccaaggggaccctaaacggttccccccttaaagttttttcggggtacctaactttacccgtttaacccgaaaaggtaaacttaaaacgggaaaaccgtacccgggtaccccgtaccgtaacgggggaccttacccccgttaacggaacccgtaaattttccgacgggtacctaccctaaacgtccgtacgggaaacaaccgaacgaccctaaccgttccgtacgtaaccaacgttaccgaccgggtaccgggggaccccctaacggacccggaaaacgggtacgtagggaacgggaacgaaccgttaaacgttacttaacggtaccgaacggggtcggttaacgggggaagtaaaacggttacgtttaaacggtttaggttaacgggttttacgttttacggggacggggtaaaccgggtaaccgggtaaggttaccgttaccggtaacccggtacgggttaaccggttacgaaccgggtacccgaaacgggttccccgtacccggtaccccccgttacgggttacccacccggtttacccgttcccggtttaccccccgg

SEQ ID NO: 167064 - DNA, 621 bp, Homo sapiens
  misc_feature: GYAE6OF02HW94O.26.71.G05.1.454.CMB.1.raw
  modified_base (296)..(296): a, c, t, g, unknown or other
  misc_feature (296)..(296): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccagcagaccctcacgctgacctgctccgtctctggattctcactcaccacgactgaggtgatgtggccgtgggtccgtcgacggaccccggaaggccctggagtggcttgcactctatttacgnggagtgatctacagcgtactactccgtctcgtagagatcgactacaccatccaaccgacggaaccacccgtaaccgaaacggtaccgggttacgttaccttaacaacgtacgaacccgaactacgtagaacgtcctaggacgaacacgagacaactattacttactgtcacacaccgtagtccgtagccgtacgtaacgacgaaagaaaagtactaagtacgtaacgttacgggttcgggaccgttaaggggttaattttccgggtaaccgtacccgttacccgtaccccgtaccggtccccttacccggaacccgtaacccggg

SEQ ID NO: 167065 - DNA, 887 bp, Homo sapiens
  misc_feature: GYAE6OF02IE0AC.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccacatcacctgctcggcagacaagttgganatagaaatgactgcctaggtacttaccgagacggccaggcccaacggttccccttaagtttttcggtaccgtattacctttacccgaaaggtacgttaaaacgaaacggtcccgggtacccgttaccggtaacgggggtacttaccccccgttacgggtaaacccccggttaaacgtttttccgtaccggggtacccttaccccgtaaaccgtttacccggttaacgggggaaacctaaacccgtaaccgggtacccccgtaaacccgtttaccgtttaacccggaaaccccgtaacgtttacccggaaacccgggggccccgggggttaacccccgtaaaccggacccggtaaaaccggggtaacgtacggggaaacggggtaacgtaaacccgttaaccgtttaagtttaccggtaccggtacgggtacccggggtaagggaaaggttaaacgtttaaccgttaggttttaacgggttaagggtttcggttttacggggaacgggtaaccggggtacccgtaacgggtacccgtacggtacccggttaccggttaacggtaccggaaccgggtacccgtaacgggtcccgttcccggtacccccggttccgggttaccacccggtttcccgttaccccggttccccccgg

SEQ ID NO: 167066 - DNA, 899 bp, Homo sapiens
  misc_feature: GYAE6OF02HN6NP.26.71.G05.1.454.CMB.1.raw
tcagagactatactcacgaccggtgctcgatttagtgtcgtcgcaagagagaggggcgtggcctcaggaagcagcatcggaggtgcctcagccatgacatggatccctctcttcctcggcgtccttgcttactgcacaggggggggggggggggggatccgtcggccttcgagtgagctgtacttcacgccctaccctctaggtcgttccggtccgtccccgaacggaccgacgacacgaccaccactaccacctcgtccgtaccggacgaacgaactaaagttagggaagaagtaagaaaagtagctagccgttaggttactttaaccgaaggacggacccgaacgggacccgtaccggttaccccgttaacgtttttcggttacgtacttacgtttacccgtaaagtaacgtaaacggaacggtacccggacccgtccgaacggggtacgtacccgttacggtaaccggttaacgtttaccgttacggtaccttacccgtaaccttacgtacgggtaaaccgaccgtaccggtaccctacccgttaccgtacgaaccctaacgtaccgaccggggacccggggaccccgaacggtaacccgaaacgggtacgttaggggaaccgggtaacgaccgtttaacgtttagttccggttaacgaacggggtcgggtacgggaaacgtaaacgttaacgtttaggttacgggtttaaggttacgggtttttacggggaaccggggtaacgggacccgttaaggggaccgttaccggggtaaccccggtttccggtaacggggttacccgtaaccgggtaaccccggtaaccgggtaccgcccgggttaaccccccggtcggttacccgtaacccgtttcccggtccccggttttaacccccg

SEQ ID NO: 167067 - DNA, 732 bp, Homo sapiens
  misc_feature: GYAE6OF02H70CX.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaattggganatagaatgactgcctggtattaccagacggccaggccagtcccctatttcggcactcttaccaagataagacgccggacctcgacgggtactcccgtagaaccgtaatttcgaggtctaccgaactcgtacggaaccacacgcccacgtcctacgtaccaactccgacggccggggtaccccaaggaccccgaaaacgggacgtagggaacgggtaaggtaaccgttaacgtttaacgttacgttacggtaacgggtacgggttacggggaacggtaaacttaaccgttaaggtttacggttaagggtttacgggtttacggggtacggggtaacggggtaacccggtagggtaaccgttaccggtaacccggttacccgttaacgggtaccgaccggtaaccccggtaacgggtacccgttacccggtcccccccggttacggttaccccaaccgtttcccggttacccggtttccccccggtccccgtttaacccg

SEQ ID NO: 167068 - DNA, 782 bp, Homo sapiens
  misc_feature: GYAE6OF02GTDCP.26.71.G05.1.454.CMB.1.raw
  modified_base (243)..(243): a, c, t, g, unknown or other
  misc_feature (243)..(243): n is a, c, g, or t
  modified_base (387)..(387): a, c, t, g, unknown or other
  misc_feature (387)..(387): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcagtcgtccgtcgtccccaggacagacacgccaccatcacctgctcggcagaactaagttggganatagaaatgctcgcctggtacttaccagacggccaggaccacgttccccttagttttcggactacgttccttaccaagtaattaacggaacgtcccggaccctacggaacggtaccttcccgtacggaacccgttaagtttcgnggtcccttaccctaacgtcggttacgggaaaccctacgaaccggacctaacccttccgtaaccgaacccgtacgttaccgaacgggccccggggaccctaacggaaccccgtaaacgggaacgtacgggtaacggggaccttaaccgttaacgttaacgtttacggttacgtaacgggtacggtttaacggggaacgtaaagtttaccgttaaggttttcggttaaacggtttgggttttacggggacggtacgggaccgtacgggtctaccgggttcccggtaaccggttaacgggtacccgtaaccggtaccccggtaacggtacccgttcccggttacccccggttaccgggtcccgtaacccgtttcccggttaccccgtttaccccccgg

SEQ ID NO: 167069 - DNA, 706 bp, Homo sapiens
  misc_feature: GYAE6OF02GAKLG.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggacagacaagttggganataagaatgctgcctaggtacttaccgagacggccaggccacgtcccctattttcggactacgttcctaccgaagtaactaaacggaacgccggccctacgacgggtacctcccgtagtaacccgtaatttccgcggtcctacctaacgttcgtacgggaaccacgacgaccctacgtctacgaccacgtcgacggtccgggacccacgacccgaaacgggagtagggaacgggtacgtaacctacgttacgttacgtacggagggtacggtaagggtaacgtaacgttaacgttagtttagggttacggtttgggtttacgggaccgggtaagggtacccgtaagggtccgtaccggtaacccgttccgtaacgggtaccgtaccggacccggtaacggtcccgttcccggtacccccgtacggtcccgtaaccgttcccgtacccgttaccccccgtaccgttacccg

SEQ ID NO: 167070 - DNA, 646 bp, Homo sapiens
  misc_feature: GYAE6OF02ILCT1.26.71.G05.1.454.CMB.1.raw
  modified_base (235)..(235): a, c, t, g, unknown or other
  misc_feature (235)..(235): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (401)..(401): a, c, t, g, unknown or other
  misc_feature (401)..(401): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaatggganatagaaatgctgcctgtattaccagaggccaggccagtcccctattttggcatcttacaagataagagcgcctnacggatccngaccgtaattctggcctaccgaactctagggaacacgacgccactctcgaccactcgacggccggggcccacgaccaaacggngtacggaagggacgaacttaactagttcggtacacgggtccggtaggggaagtaaacgttacgttaagtttgttaaggttggtttacggggacgggtaacggggaaccctagggtacccgtagggtaacccggttacccggtaacggggttaccgaaccggtaccccgtaaacgggtcccgttaccggtaccccccggttaccgggtaccctaacccgttcccggttacccggtttccccccggg

SEQ ID NO: 167071 - DNA, 681 bp, Homo sapiens
  misc_feature: GYAE6OF02HO282.26.71.G05.1.454.CMB.1.raw
  modified_base (246)..(246): a, c, t, g, unknown or other
  misc_feature (246)..(246): n is a, c, g, or t
  modified_base (328)..(328): a, c, t, g, unknown or other
  misc_feature (328)..(328): n is a, c, g, or t
tcagagactatactcacgaccggtgctcgatttagtgtcgtcgcaagagagaggggcgtgggcctcaggaagcgagcatcggaggtgcctcagccatggcatggatccctctcttcctcggcgtcttgcttactgcacaggactccgtggccttcgatggagctgacttcacgcccacctcagtcgtccgttcgccccgaggacagacacgccaccatccactgccgtcgcagactaagtcggganatacgaatgctgccgtgtactacgagacggccgagcctacgtcccttagtttcgctatctaccagatacgacgcgcctacgnggactccgagacctacgttcaggtcctaccgtaacgtcgtaacgggtaaccacgacgaccctaccgtctaccgaacccacgtccgaaccgggcccggggaccctaaccggccggaaaggtccggtaagggacggaaccgtaacttaccggtagttcgaaccggtgggtacgggtaaggtacgtaaacgtttacggtagtttacggttcgggttaggtttacgggacggtacgggaacggtaggtaccggtaccgtaaacccggttccgtaagggccgtaccggtaacccggtacgggtccttaccccgggcccccgtaggttacccgacgtttaccccgtccgttaacccccg

SEQ ID NO: 167072 - DNA, 651 bp, Homo sapiens
  misc_feature: GYAE6OF02HOI9R.26.71.G05.1.454.CMB.1.raw
  modified_base (178)..(178): a, c, t, g, unknown or other
  misc_feature (178)..(178): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
tcagagactatactcacgaccggtgctcgatttagtgtcgtcgcaagagagaggggcgtgggcctcaggaagcagcatcggaggtgcctcagccatggcatggatcccctctcttcctcggcgtccttgcttactgcacaggatccgtggccttcgatgagctgattcagccaccctnagtgtccgtgtccccaggaccagacagcccaccatcacctgctcggcagacaaagttggagatagaaatgctgcctggtattaccagacgcaggccagtccctatttgcatctcagatagancgctcaggactccgngacctattcncggctccaactcgtacgggaacacncgaccacgtacgtacgacctatccgaggccggggacccaggacccgaacggacgtacggaacgggtaactacgttaacgttacgttcggtacgtaggggtaccgtaggggtaagtaacgttacgttaaggtacgtttacggttcggttttacgggacggggtaacggaacccgttacgggaccgttaccggtaccggtacccggttacggtaccgtaccgggtacccgaaccggtcccgtaccccggtacccccggttaccgttacccggtacccgtttccgttacccggtttaccccccg

SEQ ID NO: 167073 - DNA, 781 bp, Homo sapiens
  misc_feature: GYAE6OF02JIFKL.26.71.G05.1.454.CMB.1.raw
  modified_base (137)..(137): a, c, t, g, unknown or other
  misc_feature (137)..(137): n is a, c, g, or t
tcagagactatactcacgaccggtgctcgatttagtgtcgtcgcaagagagaggggcctcgaggaagcagcatcggaggtgcctcagccatggcatggatccctctcttcctcggcgtccttgcttactgcacaggntccgtggccttcgatgagcctgattaagcccaccctcagtgtccgtgtccccaggacagacagccaccatcactgctcgcagacaattggagatagaatgactcgcctggttacttaccgtagacggccgaggccacgtccccgttatttttcggactacttccttaccgaagaagttaaagaagcccggccctacgaacggtactaccccgttaggaacccgtaatttccgtacggcttaccctacgtcgtaacgggaaccaacgacgtacccgacttcctacggacctacgacctacgggacccgggaccccgacgacccgaaacggaccgtaggaacgggacaaccgttaaacgtcgtttacgtaccggtagggtaccgggtagggaacgtaaacgtacggttaacggtttggttacggttttcgggtttaaggggtccggtaacggggtacccggtaacggttacggtttaccggaaccccgggtttcgacccggggttttacgaacccgggtacccccggttaagtaaccccggggttccccgtaaccccccggttacccggggtttaccgaaccccggtttcccggttcccccggttaccccccggtttaccccccggtttaccccggttaaccccgg

SEQ ID NO: 167074 - DNA, 791 bp, Homo sapiens
  misc_feature: GYAE6OF02I9NO4.26.71.G05.1.454.CMB.1.raw
  modified_base (176)..(176): a, c, t, g, unknown or other
  misc_feature (176)..(176): n is a, c, g, or t
  modified_base (248)..(248): a, c, t, g, unknown or other
  misc_feature (248)..(248): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgcttactgcacaggatccgtggccttcgatgagctgattcagccaccctnagtgtccgtcgtcccaggacagacacgccaccatccacctgctcggacagaactaaagtgggagatagaaangctgccgtgtacttacagaggccaggccacgttcccttagtttggctagtcttacaagagtaaagaacgcgcctcgaggctccgtagaccgtaacgtttacgtcggactaccgtaaactcgtaacggaaacacgaacgtaccctacgttacgacgtaaccagtaccgtaacgggacccggggacccaacgggtacccgaaacgggtacgttaacgggaacggggaacggttaacctaaacggtttacggtttaacggtaacggtaacggggaacggtttacggggaaaaccggttaaacttaaaccggtttaagtttaacggggtttaacggtttaacgggggtttttaccggtaaccggggggttaaacgggtaaaccggtcggggtaaccgttaaccggggttaacccgttaccgggttaaccggtaccgggaaccggggtaaccccgtaacggggtccccgtttaccccggtacccccgttttaccgggtaccctaacccgtttcggttacccggttcccccgtaccccgttaaccccgg

SEQ ID NO: 167075 - DNA, 746 bp, Homo sapiens
  misc_feature: GYAE6OF02GDCUR.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgcctcggcagacaaagttggganaatagaatgctgcctggtacttaccgagacggccaggccacgtaccccttatttcggtcattccttaccaaagataaaggaacgccggaccctacgacggggtactccccgtacggtaaccgtaaactttccgtcgggtaccttaccctaaccgttcgtaacgggtaaccaaccgacggtccctaaacctccgtacgaaccctaacgtaccgacgggaccccggggtcccaacggacccgtaaaccgggacgtcgggaacggggactaaacgttaccgttaagttcggtaccgacggggtaccggtaggggtaaactaaacgttacgttagtttaggtttaacggtttgggtttacggggacggggtaacgggtaacccggtacggtccgttacggtacccggttacgtacgggtaccgtaccggaacccgtaaacgggtccgtaccccggtacccccgttccggtacccgtacccgttccccggtttaccccctaccccttcccgttacccg

SEQ ID NO: 167076 - DNA, 762 bp, Homo sapiens
  misc_feature: GYAE6OF02H28GO.26.71.G05.1.454.CMB.1.raw
  modified_base (179)..(179): a, c, t, g, unknown or other
  misc_feature (179)..(179): n is a, c, g, or t
  modified_base (258)..(258): a, c, t, g, unknown or other
  misc_feature (258)..(258): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcctcttgcttactgcacaggactccgtggccttcgatgagctgattcacgcccaccctntaggtcgtccgtcgtccccgaggacacgacacgccaaccactccaccgtgccgtacggcaaggaactaaagttgggaanaagtagaaatcgctcgacgttaggtactaacgaggaacggtccacgggacccttaccgttccccttaagttttcggtactactccgtttaccgaaagtacgtaaacggaccggtccggtacccgtaccgacgggtaccctaccgtagaacccgttacgttttcgccggtacctaccgtaacgtacgtacgggaacccctaacacggaccctacgtcgtaccgacgtacgtccggaccgggtacccgggcccaacggaccggaacggaggtaccgggaaggtaacccgaacgttacgtttaacgttcgaccgggtaacgggtacggtaagggacgttaaaccgttagttaacggtttagttaacggggtttccgggttaggggtcccgggaagggaccgtacgggtcgtacggtacccggtacggtcggttacggaccggtacccggtaacgtcccgtcccggttaaccccggtcgtccgttaccgtcccgtaccggttcccccg

SEQ ID NO: 167077 - DNA, 691 bp, Homo sapiens
  misc_feature: GYAE6OF02HPGAV.26.71.G05.1.454.CMB.1.raw
  modified_base (140)..(140): a, c, t, g, unknown or other
  misc_feature (140)..(140): n is a, c, g, or t
  modified_base (177)..(177): a, c, t, g, unknown or other
  misc_feature (177)..(177): n is a, c, g, or t
  modified_base (244)..(244): a, c, t, g, unknown or other
  misc_feature (244)..(244): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggntccgtggccttcgatgagctgattcacgcccaccctnagtcgtccgtcgtccccaggacagacacgcccacatccacctgctcggcaagaactaaagttggganataagaatgctgctgtatacaggacgcgagccacgtcccttagtttcgctattccttacaagataagacgcgccctgaggtactcccgtagaaccgtattctgcctaccactcgtaggaaccacgacgtaccactctacgacctacgtcgacggccgggacccacggaccgaaacggacggtagggaacgggaactaaccttaacgttacgttacgtacggaagggttccgggtaagggtaaactaacgttaacgttacgggtttagttagggtttacgggtttacgggaccggggtaccgggtaaccggacggtaccggtaccggtaacccggtaccggttaacgggtacccgaacgggtaccccgtaaagggtccccgttacccggacccccggttcggtaacctacccggttcccgtttaccgtccccccgtcccttaacccgg

SEQ ID NO: 167078 - DNA, 687 bp, Homo sapiens
  misc_feature: GYAE6OF02FPGQC.26.71.G05.1.454.CMB.1.raw
  modified_base (229)..(229): a, c, t, g, unknown or other
  misc_feature (229)..(229): n is a, c, g, or t
  modified_base (351)..(351): a, c, t, g, unknown or other
  misc_feature (351)..(351): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcgcagacaattgganatagaatgctgctggtattaccgagacggccaggccacgttccccttattttcggctattccttaccaaagtactaaagaacgccggccctagacgggtactcccgtagaccgtaatttcgnggtcctaccaactcgtacggaacacgacgcctactcgtacgacctactcgacggtccgggcccacggacccgaacggtacgtacgggaacgggtacgtaaccgttacgttaacggttacgtacgtagggtaccggtagggaacgtaacgttacgttaagtttacggttaggtttgggttttacgggacgggttacgggaccgtacggtacgtccggtacccgttaccggtacggtaccgaaccggacccgtaaccggtcccgttacccggtaccccccgttacgggttcccgtacccggtttcccgtcccgtttacccccgtaccccgttaccccg

SEQ ID NO: 167079 - DNA, 707 bp, Homo sapiens
  misc_feature: GYAE6OF02IVBNJ.26.71.G05.1.454.CMB.1.raw
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
tcagagactatactcacgaccggtgctcgatttagtgtcgtcgcaagagagagggggggggcctcaggaagcagcatcgggaggtgcctcagccatggcatggatccctctcttcctcggcgtccttgcttactgcacaggactccgtggtccttcgatgagctgattcacgcccaccctcgagtcgtccgtcgtccccgaggacagacacgccaccatcacctgctcgacagactaagtgganatanaatgctgctagtactacgagacgcagcacgtcccttagttcgtcatctacaagataagacgccgacctcgacggtacctaccgtcgaaccgtacgtttcgtacgtaccttacccgtaacgtaccggtaacgggtaaccaacgaccgtacccgtaaccgttccgtaccggaaccgtacgtccgggaccgggaccccggggacccaacgggaaccccggaaacggtcggtaacggacgggactaaccgttacgtttacgtacggtaccggtacgggtacgggtaagggtaacgtaacgttaacggttacgttaggttaacggttcgggttacgggaaccggggtacggaaccggtacggtaccgtacggttaccgacggttaaggtccgaaccggaccggtacgtcccgtacccggtcccgtagtcccgttacttcccggtaccgttccccgtacctcccg

SEQ ID NO: 167080 - DNA, 670 bp, Homo sapiens
  misc_feature: GYAE6OF02FPC93.26.71.G05.1.454.CMB.1.raw
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagttcgtccgtcgtccccaggacagacagccaccancacctgctcggacagactaaagtggaanataagaatcgctgctgtataccagngccaggccacgtcccttagtttcgctactctaccaagagtaagagcgcctagacggactcccgtagacctaattcgaggacctaccaacgttcgtacgggaaacctacgtacgaccctacgttccgtagacccataccgacgggtcccgggacccacggaaccgaacggtaggtacggaacgggactacttacgtaggttcgtcggaacggtcggtaacggggtaataaacgttaacgtttacgttaaggttaggtttggttacggggcgggtaaacggtacgtaacgggttctacgggtacccgtacggttcggaccgaaccggtaccccgtaacggtcccgttaccccgggtacccccgttacggtaccctaccgttccccggttaccggttaccccccgg

SEQ ID NO: 167081 - DNA, 878 bp, Homo sapiens
  misc_feature: GYAE6OF02GEX1V.26.71.G05.1.454.CMB.1.raw
  modified_base (178)..(178): a, c, t, g, unknown or other
  misc_feature (178)..(178): n is a, c, g, or t
  modified_base (246)..(246): a, c, t, g, unknown or other
  misc_feature (246)..(246): n is a, c, g, or t
  modified_base (805)..(805): a, c, t, g, unknown or other
  misc_feature (805)..(805): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctnagtcgtccgtcgtaccccaggaccagacacgcccaccatccacctgcctcggcagacaaagttggganataagaatcgactcgtcctggttaacttacccgaggacggtacccgaacggtccccgtaaccgttccccccgtttaagtttttccgggaccttaacgtttcccgttaacccgaaaaggtaacgttaaaacggaacggtcccggggtacccctacggtaacgggggtacccttacccccggtacggtaaccccggttaagtttttcccggacgggtaccccttaacccgtaaacccgtttcgggttaaccggggaaaaccctacccgtaaccgggtaccccctaaccgtttccgtaaccggaaccccttaagttacccggaacccggggcccccgggggtaacccccaacgggaacccccggaaaacggggtacggttaaccggggaaacggggtaacccgtaacctttaaccgttaacgtttacgggtaaccgtaacgggtccgggttaagggaacgttaaagttaaccgttaggttttacggtaaggtttgggttacggggacgggtaacgggtaccgagggttaccgtacggttacccggtacggtacgggtaaccncccgggaacccgtaacggtccgttaccccggccccgttacggtaccctaccgttcccgtccgttacccccccg

SEQ ID NO: 167082 - DNA, 739 bp, Homo sapiens
  misc_feature: GYAE6OF02I1WPE.26.71.G05.1.454.CMB.1.raw
  modified_base (180)..(180): a, c, t, g, unknown or other
  misc_feature (180)..(180): n is a, c, g, or t
tcagagactatactcacgaccggtgctcgatttagtgtcgtcgcaagagagagggggtgcctcaggaagcagcatcggaggtgcctcagccatggcatggatccctctccttcctcggcgtccttgcttactgcacgaggactccggtggccttcgatgagctgacttcagcccaccctnagtcgtccgtcgtccccgaggacagaccagcccacatccaccgtcgctcggcaaggtaacaaacggttgggaatataagaaattcgacgtcgaccgttaggtactaccgagacggccgtagacctaccgttcccttagtttccggactacttccgtacaagtaacgtaacggtacgacccggtccctacgagggtacctaccgtagtaaccgttacgttccgtacgacctacgtaaaccgtcggtaacggaacctaacgtacgtacctaccgtcgacgtaccacgttacgaccgggtcccggacccgacggtaccgaacgggtctaacgggaacggtacgaaccgttaacttagtaccgtcggtaacgggtacgggtaacggtaagtaacgttaacgttagttaacggtttaggttacgggttacgggtacgggaacggtaccgtacgggtaccctacggttaccgtacggttacggacccgaacggtacccgtacggaccggttccccgaccccgggttctacccgtacgttaccccgttacccgtccccgttacccg

SEQ ID NO: 167083 - DNA, 671 bp, Homo sapiens
  misc_feature: GYAE6OF02IMX0U.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccaccatcacctgctcggcagacaagttggganataagaaatgctgcctggtacttaccgagacggccaggccacgtacccctttagttttcggtctacgttaccttaccaaaggtaactaaaggaacggccggtaccctacgacgggtactccccgtagtaaccgtaattttccgtaggacccttaccgaaaccgttcgtaacggggaacctaaccgaccgtaccctaacctcgtaccgaccctaactccggacggcccggggaccccacggacccgaaacggtagtacgggacgggaagtaacctagttattcgtacgaggtcggtaggaagtaactagttacgttggttacgttggttgggacggacgggtaccgacggtacgtcgtaccggtcgtaacggtcgaacgaccgaagtcccgtacccgcccgtcgtaccgtaccgttccgtccgtccccgtccctccg

SEQ ID NO: 167084 - DNA, 808 bp, Homo sapiens
  misc_feature: GYAE6OF02F560D.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccacatcacctgctcggcagacaaagttggganattagaaatgctgctaggtacttaccgagtacggccagggcccacgttacccccgttaagtttttcgggtacctacgtttcccgtttacccgaaaggtaacgttaaaacggaaacggtcccgggtacccccttacggaaccggggtaccttaccccgtacggtaacccgttaagttttcccgtacgggtacccttacccgtaaacgttccggttacggggaaaaccctaccggtaacggtacccctaacgtttacccgtaacggtaacccctaacgttacccggaacggggttaccccgggggtacccccaacgggtaaccccgaaaaccggggtagttaccgggaaacggggtacgaaaccgtttacgtacgtttacggaccggtagggtaccggttagggaacgtaaacgttaccgtttagttacggttaggtttacgttcggggaacggacgggtaccgagggtccgtacggtacccgttcggtaacgggtcctaacccggtaccgtaacggtcccgttcccggtccccgttacggtaccaccgtttccggttacccgttccccccgg

SEQ ID NO: 167085 - DNA, 751 bp, Homo sapiens
  misc_feature: GYAE6OF02FQP8R.26.71.G05.1.454.CMB.1.raw
  modified_base (320)..(320): a, c, t, g, unknown or other
  misc_feature (320)..(320): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgcctcggcagacaagttggagatagaaatgctgccgtggtattaccaggacggccaggccaacgtcccctagttttcggtctatcttaccaagataagaacgcgccctnacggctcccgtgaccgtaattctggctacctaactctacgggaactacgacgaccctacttaccgtgaacccagttccgacggtacccgggggaccccaacgggaccccaaacccgggtagtacgggaacggggtaaccgaaccgttaaccgttaaggtttcggtaccggtacgggtaccgggtaggggtaagtaaaccttaaccgtttagttaggttaaccggttttgggtttaccgggtaccgggggtaaggggtaccccaaggggtccgttaaccgggtaacccggttacccgttaacgggtacggtaaccccgggacccggtaaacgggtcccggttaccccggtacccccgggttaccgggttaccccgttaacccggttccccggtttaaccccggtttcccccggtacccccctttaccccggg

SEQ ID NO: 167086 - DNA, 732 bp, Homo sapiens
  misc_feature: GYAE6OF02I9CCF.26.71.G05.1.454.CMB.1.raw
  modified_base (137)..(137): a, c, t, g, unknown or other
  misc_feature (137)..(137): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggntcccgtggccttcgatgagctgattcagcccaccctcagtcgtccgtcgtcccaggacagacagccaccatcacctggcctcggcagacaaagttgggaagatagaatgctgcctgtattaccgagaggcccaggccacgttcccctagttttaggctattcttaccaagtaactaaggaacgccggtcccgtacgagggtaactccccgtacggtaccgaattttcgcggtcctaccctaacgtccgtagggaaacctacaaccgccctacctcctacggaccctaagtaccgtaccggacccggggtccccaaggtaaccccgaacgggtacgtaggggtaacggaacggtaccgtacgttaatttcgggtacgaacggggttccgtagggaaaccgtaacgtttaacgttacgtttaggtttaaggttcgggtttacggggtacggggaacgggtaaccggtacgggtacgtaccgggtaacccggttcgttaacggggtaccctaaccgggttaacccgaacgggtaccgtcccggtaaccccgtcgggttccacccggttacgttacccgttcccccgtccccgttaccg

SEQ ID NO: 167087 - DNA, 720 bp, Homo sapiens
  misc_feature: GYAE6OF02GOCG5.26.71.G05.1.454.CMB.1.raw
  modified_base (116)..(116): a, c, t, g, unknown or other
  misc_feature (116)..(116): n is a, c, g, or t
  modified_base (175)..(175): a, c, t, g, unknown or other
  misc_feature (175)..(175): n is a, c, g, or t
tcagagactatactcacgaccggtgctcgatttagtgtcgtcgcaagagagaggggctgggcctcaggaagcagcatcggaggtgcctcagccatggcatggatccctctcttccncggcgtccttgcttactgcacaggatccgtggccttcgatgagctgattcagccacctnagtgtccgtgtccccaggaccagacacgccaccatccacctgctacggcagaactaaagttcgggagtagtaagaatgacgtcgccttaggttaacttaccgagtacggaccaggccctacgtcccttagttttcggactattctaccgaagattaagaacggtccggtaccctacggacgggtactccccgtacgtacccgttaagtttcccgaggccttaccgtaaacgttcgttacgggaaacctaccgaacggtaccctaccgttaccgtacggtaaccctacgtacccgtaacgggccccggggtacccgaaccggtacccgaaaccgggtacgtacgggaacgggtacgaaccttaacgtacgtttacggacgtaggtaccggtaagggaacgttaaacgtacgttacgttagttacggttggtttacgggaccggtacgggtaccgaggtaccgttaggacccgttacggtaccggttacgcggtaacccggagtccgtacccgcccgttacggacctcgtacccttccgttaccccg

SEQ ID NO: 167088 - DNA, 946 bp, Homo sapiens
  misc_feature: GYAE6OF02HVU2M.26.71.G05.1.454.CMB.1.raw
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccttgaaggagtctggtcctgcgctggtggacgcccagcagaccctcacgctgacctgcctccgtctctggtattctcactcaccacgactggaggtgaatggtcggccgtgggtccgtcgaccgggacccccgggaaaggccccgtagggacgttcgggaccgtttcggaccgtaccttaccgtaatttttaccggtagggtaacggttacggtaacttaccgttaccgaaacgggtacccgggttaaaccgtaaaccgttcccggtttaccttaccgttaagggtaacgggttaaacgtacccggtaacccttacccgaacccgttaaattaccccggaaaccccggaacgggggtaaacccctaaccccgttaaacccggaaaaacccgggggttaaccccgggggtttacccggtttaacccgttttaaacccgtaaacggtttaaccggaaaccccgggtaaacgttaaacggtttaaccgaaaaccgtttcccggtttaacgggaaccgggtaaaccgtaacggtaaccgggaacctaaaccggttaactttaacggtttaaccgttcggttaacgaacccttaaacgtaaccgtaacggtttaccccgtaacgggtcccggttaaccgtaaccgggtaaccggaaaaaggtaaaaaccgttaacgttaacgtacgggttaaccgtttagggtaaccgggggtaacccgttaagggggtttaaccgttttaccgggtacccgttaaccccgtcccggttaccccgtaaccggtacccctacccggaaccccggtaacccgggg

SEQ ID NO: 167089 - DNA, 809 bp, Homo sapiens
  misc_feature: GYAE6OF02HVIPN.26.71.G05.1.454.CMB.1.raw
  modified_base (115)..(115): a, c, t, g, unknown or other
  misc_feature (115)..(115): n is a, c, g, or t
tcagagactatactcacgaccggtgctcgatttagtgtcgtcgcaagagagaggggctgggcctcaggagcagcatcggaggtgcctcagccatggcatggatccctctcttccnggcgtcttgcgttactgcacaggatccgtgaccttcgatgagctgattcacgccaccctcagtgtccgtcgtccccgaggacagacagccaaccgatccactcgctccggacagaacctaaagttcgggaacgtaatacgtaaagtcgtactacggccgttaggtaacgttaccaggacggtccgacggtacccgtacgttacccccttaagtttttcggaccgtacgttaccttaccgaaagtacgtaaaagtaccggccggtacccttaccggaacgggtaccttaccccgtaggtaaacccgttacgttttaccgaccgggtaccttacccgtaaacgttacggtaccgggaaactaaccgtaaccgtacccgttactaccgtacgtaccgtaacttcccggaacggaccccgggggtaaccccaacgggtaacccgtaaaccgggtacgttacgggaaacgggtaccttaaaccgttacgtttaacggtacgttaacccggtacggcgggttaaacgggtaacgtaaagttaacgttacggttaggtttaacggttcgggttttacgggaaccgggtggtaaccgtaggtaccgtacgtacccggttacgtacggtacgtaccggtaaccgtacggtacccgttaccggtacccccggtgtaccgttacgtccccgttaggtaccccccg

SEQ ID NO: 167090 - DNA, 651 bp, Homo sapiens
  misc_feature: GYAE6OF02F8AA3.26.71.G05.1.454.CMB.1.raw
  modified_base (310)..(310): a, c, t, g, unknown or other
  misc_feature (310)..(310): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggcagacagccaccatcacctgctcggcagacaaattgggagatagaaatgctgcctggtattaccagaggccaggccagtcccctattttggtcatctccaagataagaagcgccctnagggatccctgaccgaattctggctccaactctacggaacacagtcccacgtcctacaccatccgacggcccggggaccctacgacccgaaacggacgtggaacggggtaagaacgtactaagttcgtacgaggcggtgggaataactaacggttaatttagggttacgttggttttacggggccggggtaagggtaacccggagggttaccgtacgggtacccggttaccgtaagggtacccgtaacggtaccccgtaaggggtccctccggacccccccgtttcgggtaccccgtaccgttacccgttccggtttaccccccaccccgttttaaccccg

SEQ ID NO: 167091 - DNA, 700 bp, Homo sapiens
  misc_feature: GYAE6OF02H41VR.26.71.G05.1.454.CMB.1.raw
  modified_base (246)..(246): a, c, t, g, unknown or other
  misc_feature (246)..(246): n is a, c, g, or t
tcagagactatactcacgaccggtgctcgatttagtgtcgtcgcaagagagaggggctgggcctcaggaagcagcatcggaggtgcctcagccatggcatggatcccctctcttcctcggcgtccttgcttacctgcacaggatccgtggccttcgatgagctgattcagcccaccgtcagttcgtccgtcgtccccaggtccaggtacacgccaccatccacctgctcggcagacaagtggatanaagtaatgtctagccgtaggtacttaccgagacggccacggccactccccgttagtttgctactctaccgaagataacgacgccgtcctcgacgggtcctcccgtaggtacctacttcgcgtacctacccgaacttacggtacggaacctaaccgaccgtacccgtaacttccgtaacgtaacccctacggtaacccgcgggtaacccccgggggtaccaacccggttaacccggaaacgggtggtaaacgggacgggtaaacctaaccggttaatttacggttacgaccggtacgggtaccggtaggaacgtaacgttatacggttagtttaacgggttcgttacgggcggtacggacgtacgacctaccgggtacccgtcgttacgccggacgtaccccgcggtcccgttacccgcccggttccgacgttcccttccggttccctacccccg

SEQ ID NO: 167092 - DNA, 847 bp, Homo sapiens
  misc_feature: GYAE6OF02HN7AN.26.71.G05.1.454.CMB.1.raw
  modified_base (177)..(177): a, c, t, g, unknown or other
  misc_feature (177)..(177): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggactccgtggccttcgatgagctgattcagccacccctnagtcgtccgtacgtccccaggacagacacgcccaccatcacctgcctcggcaacgactaaagttggggataataagaaatcgactcggccgttagttacttaccgaggaccggccgaacgggccctacgttaccccccgttaagttttcggtacctactttaccgttaaccctaaagtaagtaaacggaaacggcccggtaaccccgtcggtaaacgggtacctccccgtaacggtaacccgttaaccttttccggtacgggacccttaccgtaaaccgttcggttaacgggaaccttaaccgaccgaccctacgttacctccggtaaacctaccgtacggccggtaacccggggaccccgaaccggacccgtaaaacggggtacggttacggggaaacgggttaaccgtaaccgtttaactaacgggttttccggacgtacggggttacggttacgggggtaactaaacggttaaccgttaagggtttacggtttagggtttaccgggttaggggtaccggtaacgggacccggtacggtaccgtccggtaacccggtccgttacggtacccgggtacgaacccggtaccgggtaccgtcccccggttaaccctccgggtaccgttacccgttcccggtttaccccgtccccgtacccccgttacccgg

SEQ ID NO: 167093 - DNA, 612 bp, Homo sapiens
  misc_feature: GYAE6OF02GEQIS.26.71.G05.1.454.CMB.1.raw
  modified_base (178)..(178): a, c, t, g, unknown or other
  misc_feature (178)..(178): n is a, c, g, or t
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctnagtgtccgtgtccccaggacagacagccaccatccacctgctcggcagacaaagttgganatagaatgctgcctggtattaccagacgccaggccacgtccccttagtttcggctatccttcaagtataacgaacgccggaccctcgaggactcccagaccgtaattcgtgcctaccaactcgtagggaaccacgacgccactctacgacactagacggccgggacccacggacccgtaaggacgtacgggaacgggactaacgttactagttcggacgacgggtacggtagggaataagtacttagttagtagttgggttacgggacggacggaccggtacggcgttacggaccgttacggtacggtcgaccgacccgtaaggccgttacccgccccgtacggttacccgaccgttccgtaccggttcccccg

SEQ ID NO: 167094 - DNA, 825 bp, Homo sapiens
  misc_feature: GYAE6OF02GI5JT.26.71.G05.1.454.CMB.1.raw
  modified_base (218)..(218): a, c, t, g, unknown or other
  misc_feature (218)..(218): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcacgccaccctcagtcgtccgtcgtccccaggacagacagcccacactacaccgtgctcggacaagaacaaagttggggaanaataagaaatcgcgtacgccgttaggttaacttaaccaagggacggccgaacggtcccaacggttcccccttagttttcgggaccttaacttcttaacccaaagtaataaaacggaacggtaccggtccccttacggaaggggtaccttcccgtaacggtacccgtaaactttcggtacggtcctaccaaccttcgtaacggaaccaacgtaaccgaccctacgtcctaaccgaactacgttaacccgacggggaccggggaccccaaacgggaaccccgtaaaacgggacggtaacgggaacggggaactaaccgtaccgtaagtttccgtaacgtaacgggtacgggtagggtaaacgtaaattaacgttaacgttaggttaacggttgggtttaacgggtacggggtacgggaaacccgtaggggtaaccgttcggtaaccggttacccgttacggtaaccgaaccggtaccgtaaacgggtcccgtaacccgtccccgggttccgtacccgtaccttccggtacccgttccccgacccgtttacccggtacttaccggttaacgttcgtaccgttcgaccggtacgggtccgggacgtacggg

SEQ ID NO: 167095 - DNA, 725 bp, Homo sapiens
  misc_feature: GYAE6OF02GD15S.26.71.G05.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtcgtaccccaggacacgacacgccaccactcacctgctcggacagacaagtgganatagaatgctcgctgtactaccagacgcacggccacgtcccttagttttcgactacttcttaccaagtactaacggacgccggtcctacgaggtactcccgtacgaccgtaattcgtacgtcctaccgtaacgtccgtaagggaaaccacgaccgtaccctacttccgtaacgacctactaccggaacgggtccccggggaccccaacgggacccgtaaaccgggagtacggggaacggggaacgtaaccggttaacttacgtttacggtacgtaacgggtaccgggtaggggaaacgtaaacgtaacgtttagtttacgggttaggtttcgggtttacgggaccgggtacgggtaaccgtacgggtaccggttacgtacccggttaccggttaacggtaccgtaccggtaacccggtacggtacccgttccgggtacccccttacgggtaccctaccggttcccgttcccggttccccccgg

SEQ ID NO: 167096 - DNA, 734 bp, Homo sapiens
  misc_feature: GYAE6OF02HCZ2Z.26.71.G05.1.454.CMB.1.raw
  modified_base (241)..(241): a, c, t, g, unknown or other
  misc_feature (241)..(241): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatccacctgctcggcacgactaaagttggganatagaaatgctgccgttggtacttaccgagacggccaggcccgacgttccccttagttttcggtactacgttcttaccaagtataaagaacgccggccctgaacggctacccgtgaaccgtaatttctacggcctaccctaacgttccgtagggtaaaccacgtaaccgacccgtaaccttccgtaccggtaacctacgtacccgacggggaccccgggggtacccccaaggtaccccgaaacgggtacgtacgggaaacgggtacgtaaccgttaacttaacgtttcggtacggtacgggtaccgggtaggggtaacgttaaacgttaacggtttagtttacgttaggtttcggggtttacgggcggggtaacggaccggttagggccggttaccggtaccggttcccggtaacgggtccgtaaccgacccggtaacgtccgtacccggtccccggttaccggtccctaccgttccgttccgtaccccccgg

SEQ ID NO: 167097 - DNA, 629 bp, Homo sapiens
  misc_feature: GYAE6OF02IEB5W.26.71.G05.1.454.CMB.1.raw
tcagagactatactcacgaccggtgctcgatttagtgtcgtcgcaagagagagggggggcctcaggagcagcatcggaggtgcctcagccatggcatggatccctctcttcctcggcgtccttgcttactgcacaggatccgtgccttcgatgagctgacttcacgcccaccctcgagttgtcccgtcgtccccaggacagacacgcccaaccatccacctgcctcggacaagaactaaagttggaagtacagaatgctgcctgtataccagacgcagccacgtccctattcgtcattctacaagtataagagccgccgtcgacgggactaccgtgaccgtactttcgcggtcctacaactcgtacggaacacgacgccactctacgaccaactcgacggccgggacccagaaccgacggagtaggacggacgtacgtactagttacgacggacggtacgtagggactaaacgttcttaagttacggttaggttcggttaggacggtaaggaccgtaggcgttacgacccgttagtacggtaccaccggaccgacgggtccctacccggtcccccgttacggacccttaccgttaccgtttcccccgtacccgtaccccgttaacccgg

SEQ ID NO: 167098 - DNA, 640 bp, Homo sapiens
  misc_feature: GYAE6OF02GDMHW.26.71.G05.1.454.CMB.1.raw
  modified_base (236)..(236): a, c, t, g, unknown or other
  misc_feature (236)..(236): n is a, c, g, or t
  modified_base (404)..(404): a, c, t, g, unknown or other
  misc_feature (404)..(404): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacctcagtcgtccgtcgtccccaggacagacacgccaccatcacctgctcggacagaacaaagttggganatagaatgctgcctggtattaccagaggccaggccacgtcccctattttggctatctccaagataagacgcgcctcgagggactccctgaccgtattctacggctccaactcgtacggaacacacgccactctacgaccatcgacgccggggcccacgcccgaacggngtacgggaagggtacgaactacgttagttcggtaccgtaggtcgggtaggggaagtaacgttaacgttagtttacgttaggtttcgggttagggacggggtacgggtaaccgacgggtcgttaccggaccggtttaccggtacggtaccgaacggaccccggtaagggcccgttcccggtacccccgttaccgggtcctacccgttacccgtccgttccccgtaccccgttacccg

SEQ ID NO: 167099 - DNA, 778 bp, Homo sapiens
  misc_feature: GYAE6OF02HYI1N.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgcttactgcacaggatccgtggccttcgatgagctgattcacgccaccctcagtcgtccgtgtccccaggacagacagccaccatcacctgctcggacagaacaaagttggganaatagaatgctgcctggtattaccgagacggccgacggccacgttccccttagttttcggtacctaactttccgttaaccgaaaaggtaacttaaaacggaaaccggtaccggtacccccgttacggtaacggggtaccttaccccgtacggtaaacccgttaacggtttttaccgtcgggtacccttaacccgtaaccgttccggttaaggggaaccaaccgaacggtaccctactacctacgaaccctagtaccgaccgggtacccggggacccaaacgggtacccgaaacggtacgttacgggaacgggtacgaaccgttaacttaacgttacggtacgacggggacgggttaacgggtaacgtaacttacgtaaggttttaggtaggtttcggttacgggtagggtaaccggggtaacgtacggtacgtcgggtaacccgtcggtacggtacggaaccggtaccgaacgggtccctccgtccccgttaccggttaccctaccgttacccgtccggttacccctacccgtacccg

SEQ ID NO: 167100 - DNA, 711 bp, Homo sapiens
  misc_feature: GYAE6OF02JH3AE.26.71.G05.1.454.CMB.1.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagaccagccaccatcacctgctcggcagacaaattggganatagaatnctgcctggtataccagngccaggcngtcccctatttggcatcttcaagataagacgacgccctangggtactccctagaccgtaattcgngctaccaactcgnggtaacacgtacgccacgtcctgaaccatcgacggtcccggggaccccaggaccccgaaacgggtacgtacgggaacgggtacgtaaccgttaccgttaacgtttcggtaccgacgggtacggttacggggtaaacgtaaacgttaaccgttaaggttacggttaacgggtttcgggttttacgggaccgggggtttaaccgggaaccgggtaacgggttcccgttaacggttacccgggttaccgttaacgggttacccgtaaacggtaaccccggtaaacggtcccgttacccggtcccccgttaccgggaccgtttaccccgtacgtttcccccggttcccccggtaccccgtttaccccgg

SEQ ID NO: 167101 - DNA, 634 bp, Homo sapiens
  misc_feature: GYAE6OF02HMH7E.26.71.G05.1.454.CMB.1.raw
  modified_base (290)..(290): a, c, t, g, unknown or other
  misc_feature (290)..(290): n is a, c, g, or t
tcagagactatactcacgaccggtgctcgatttagtgtcgtcgcaagagagaggggggactcctgtgccccaccatggacacgctttgctccacgctcctgctgctgaccatcccttcatggtcttgtcccagatcaccttgaaggagtctggtcctgcgctggtggagccccacgcagaccctcacgctgacctgctccgtctctgattctcactcaccacgactgaggtgaatgtggcctgggtccgtcgacggacccccggaaaggccctggacgtggcttgcactntatttacgtggatgactctacgaagcggtactaacgtccgtctcgtagaggtaactccgactccaacactaccaaccgacggaccacctaaccgaaacgtaccgggtcgttaccttacgaagtcgaccgacagtacgaactccgtaggtacggaacctacgaggaccaacgtaattacgtttaacgtcgtataccgaacacgtacgtaccgtacgcggtaccgtaaccgaacgtaaagaaaaacgtactaagtacgtaccgttagggttcggtaaccgtaagggttaagttttccggaacgttacccgtcccgtacccgacaccctaccgaaccggtaacccgg

SEQ ID NO: 167102 - DNA, 650 bp, Homo sapiens
  misc_feature: GYAE6OF02IB84D.26.71.G05.1.454.CMB.1.raw
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccacctatcacctcgctcggcagacaattgggananagaatgctgctaggtattaaccagacgcaggccacgtcccttattggtcacttctaccagtanaagagcgcctgagctccagactacttcncgtctccaactcgacggaacncgacgaccacgtctacgacagcgacggccggacccacggtaaccgaaccggtaagtcgggaagggtaacgtaccgttaaccgttacgttcgtacggtacgggtccgggtaagggaaggtaacttaacgtaggttttaacggttagggtttagggtttacgggacggggtaacggaccggtaacgggtaccgtacgggtcccggtaccgttaacggaccggtacgacccggtaacggtacccgttcccgggtcccccgttcggtaccgtccgttacccgtcccgttaccccctacccgtccccg

SEQ ID NO: 167103 - DNA, 737 bp, Homo sapiens
  misc_feature: GYAE6OF02GAYYI.26.71.G05.1.454.CMB.1.raw
  modified_base (648)..(648): a, c, t, g, unknown or other
  misc_feature (648)..(648): n is a, c, g, or t
  modified_base (717)..(717): a, c, t, g, unknown or other
  misc_feature (717)..(717): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgttccttgcttactgcacaggatccgtggtccttcgatgagctgattcagcccaccctcagttcgtccgtcgtccccgaggaccagacacgcccaccatccacctgccgtcggacacgaactaaagttgggaataagttaacggaaagttcgacgttcgtcccgttggttaacttaaccgtacggacggaccgacgggtcccgtaaccgtttaccccgtttaaggttttcgggtacctaacgtttcccttaccgaaagtaacgttaaacggaacggtcccggtacccgtacggaacggggtacctccccgtacgtaaccgttaacttccgtacggtccctacctaacgtcgtacggtaaccaccgacgccctacgtccacgtaccacgtaccacgggccccgggaccaccggtaccgaacggtagtacgggaacgggacaccgttaacgtgttacgcgggtagtcggtagggtaactacgttaacttagttacggttaggttcgggtttggaccgggtaaggacccngggttacctcgggtaaccgtcgtaacggtccgacgtaccgtacggtccgcccggtcccgtaccggtccnccgttccgtcccgtcccccg

SEQ ID NO: 167104 - DNA, 748 bp, Homo sapiens
  misc_feature: GYAE6OF02HY5K0.26.71.G05.1.454.CMB.1.raw
  modified_base (206)..(206): a, c, t, g, unknown or other
  misc_feature (206)..(206): n is a, c, g, or t
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagtatcggaggtgcctcagccatggcatggatccctctcttcctcggcgtccttgcttactgcacaggatccgtggccttcgatgagctgattcagccaccctcagttcgtccgtcgtccccaggacaggacngccacatcacctgctcggcagactaagtgganatagaatgctagccgtaggtacttaccaggacggccaggcctacgtcccctttagttttcggtactacttcttaccgaagtaataacggaagccggtaccccttaggacgggtactccccgtcggaacccgttatttccgtcggtcccttaccgtaacttcgtacgggaaacaccgtaccgtaccctaccgttcttacgaccctactaccgtacggcccggggacccgtaacggacccggtaagggtacgtacggggacgggtaacgtaaccgtacgtttacggttagtaccggtagggtaccgggtagggtaacgtaacttaacgttagtttacggtagggtttacggtttacggggacgggttaacggggaccggtacgggtacccgtaccgggttaccgttaccggttacggtaacccgtaccgggtaacccgtacgggtcccgtacccgtcccccggtttacggaccgttacccgttaccgtttccccggtacccccttaccccgg

SEQ ID NO: 167105 - DNA, 765 bp, Homo sapiens
  misc_feature: GYAE6OF02JMWMC.26.71.G05.1.454.CMB.1.raw
  modified_base (212)..(212): a, c, t, g, unknown or other
  misc_feature (212)..(212): n is a, c, g, or t
  modified_base (688)..(688): a, c, t, g, unknown or other
  misc_feature (688)..(688): n is a, c, g, or t
  modified_base (697)..(697): a, c, t, g, unknown or other
  misc_feature (697)..(697): n is a, c, g, or t
tcagagactatactcacgaccggtgctcgatttagtgtcgtcgcaagagagagggggccgtcaggaagcagcatcggaggtgcctcagccatggcatggatccctctcttcctcggcgtccttgcttactgcacaggatccgtggccttcgatgagctgattcacgccaccctcagtcgtccgtcgtccccaggaccagaccagaccaccanccacctcggcctacggccaagactaaacgttcgggaaggactaagaaatgacgtacgtccgtggtaacttaccgaaggtacggcccgaacggcctaccgttccccttagtttggtacctcttaccttaccgaaacgtaacgtaacgaacggccgacccgttacggacgggtactaccccgttacggaaccgtagtttccgacggtccctaccgtaaccttaccggtagggaaccaacgtaccggacctaacccgtctaccggtacctacgccggtaccgggccgggtacccaaccgggtaacccggaacgggagtacggggacggtaaccgtaacgtaaccgtaacggttcgtaacccggttaggggaccggttaaggaaccgtaagttaaccgtagggtttacgttagggttcgggttacgggacggggttacggtaaccgggtacggacgtcgtacccggtcgtaccgggtacncccgggtanaccggtaccctacccggtcccggtcccggtacctccgtccctttacccgttaccccgaccccttacgg

SEQ ID NO: 167106 - DNA, 594 bp, Homo sapiens
  misc_feature: GYAE6OF02FOCZT.26.71.G05.1.454.CMB.1.raw
  modified_base (177)..(177): a, c, t, g, unknown or other
  misc_feature (177)..(177): n is a, c, g, or t
  modified_base (236)..(236): a, c, t, g, unknown or other
  misc_feature (236)..(236): n is a, c, g, or t
  modified_base (372)..(372): a, c, t, g, unknown or other
  misc_feature (372)..(372): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatccacctgctcggcagacaattggganatagaatgctgctgtattacagaggccaggccacgtccccttattttcggtctactcttccaagtataagacgcgccctcagggactccgtacgacgtacttcgtgtctccaactcgtaggacacgacgccactcncacatcgacgccgggaccacgacccgaacggagtaggacgggtacgaccgttaacgtagttagtccgaggtacggtagggagtaacgttacgttagttagttaggttaggtttacgggtacggtacgggtacgtacggtacgtacgtaccgtacgtacggtacaccgacccgaggtaccgtccggttccccgtcggtcctacccgttcctcccggttccccg

SEQ ID NO: 167107 - DNA, 769 bp, Homo sapiens
  misc_feature: GYAE6OF02HEA82.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacacgccaccatcacctgctcgcagactaaagttggganatagaaatgctgcctgtataccagagccaggccactcccttagtttggactacttcttacaagataagaacgtccgaccctgacggactacccgtagaaccgtaatttcgtacgggtacctcctaaacgtcgtaacgggaaaccacgaacgtcccaacttccgtaacgaaccctaactccggaacggacccgggggacccctaacggaccccggaaaacgggtacgttaacgggaacggggtaaccgaaccggttttaaccgtaagggtttaccggtacggtaaaccgggttacgggtaacgggggtaaacgtaaaacggttttaacgttaaggttttaacgggtttacgggttttaggggtttaccgggggaacgggggttaaccggggtaaacccgggtacggaccggtttacgggaacccggtttacccggtaaggttaccccggtaacggaacccgtaaccgggtccgttacccggccccgttacggtaccctacgttcccgtacccggttccccgtacccgtcccg

SEQ ID NO: 167108 - DNA, 880 bp, Homo sapiens
  misc_feature: GYAE6OF02I9T16.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcgagtcgtccgtcgtccccaggacagcacgccaccatccacctgcctcgcagacaaagttgggagaatagaaatgactcgaccgttggtacttaccaggacggcccacggcctacgttccccttattttacgggtcattaccttaccaaagtaacgtaaacgaacggtcccgggaccccctacggaacggggtacccttacccggtagggtaaccccttaaacgttttcccggttacgggaaccctttaacccgtaaaccctttcgggtaccgggtaaaccacccgtaaggtaccccttaaccttcccggtacgtaaacccctaggtacccgaccgggggacccgggaccccgtaacggtaaaccccggaaacgggtaacggttacggggaaaccgggaacggtaaacccgtttacggttaacgtttacgggtaccgtaacgggggtaccgggtaaggggtaaagtaaaccggtttaacgttaaggttttaagggttacgggtttttgggttacggggtaccgggggtaaaccgggttaaccggacggggttaccggtaacccggttaccgggttacccgtaacgggtacccggtaaccggtaccccgtaaccgggtccccgttaccccggggtacccccggtttaccggttacccgtaacccggtttcccgttaccccggtttacccccgtaccccccgttaccg

SEQ ID NO: 167109 - DNA, 708 bp, Homo sapiens
  misc_feature: GYAE6OF02H6QV7.26.71.G05.1.454.CMB.1.raw
  modified_base (529)..(529): a, c, t, g, unknown or other
  misc_feature (529)..(529): n is a, c, g, or t
tcagagactatactcacgaccggtgctcgatttagtgtcgtcgcaagagagagggggggcctcaggaagcagcatcggaggtgcctcagccatggcatggatccctctcttccgtcggcgtccttgcttactgcacaggtactccggtggtccttcgattggagctgattcacgcccaccctcgtagtcgtccgtcgtaccccgaggacagaccacgaccaaccatcacctgccgtcggacaagaacgtaaagttgggataacgtaagaagtgactcgccttcggtacttacgaggacggaccacggacccttacgtacccgtttaagttttcggtctacttaccgttacaaagtataacgacggtacccggacctacggaacgggttctaccccgagtaaccgttaagttaccgttcggtacctaccaacgttcggtaacgggaacaaccgcgacctacccgtcgtacctacgtacgcgtaaccgggccgggacccctacggaccgaacgggactacgggaacggganaaccgttacgttagttacgtacggacgttaccgggtagaaggtactacgttaagtagtacggttgttacgggacggtacgcgtaggccttacggacccgttacgtacggctacggaccgtacgtccgtacccgacccggttcgtaccgtacctccggttcctaccccgtaccttaccgg

SEQ ID NO: 167110 - DNA, 754 bp, Homo sapiens
  misc_feature: GYAE6OF02GJOCC.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcgacgccaccctcagtcgtccgtcgtccccaggacagacacgccaccatccaccgtgcctccggcacgaacaaagtgggaagtaataaggaaatgcctagtccttagggttactaaccaggacggccgaacggcccacgtcccccgttaatttttcgggtactacgttccttaccgaaagtaactaaacggaaacggccggtccccgtacgacggggtaccttccccgtacggaacccgttaatttccgtacggtcctaccgtaactcgtacggaaacctacgacgtccactccgacgacccatccgaggcccgggacccaccgaccgaacggtacgtagggacgggaacgtacctacgttagttcggtacggacgggtacggtagggacgtaaacgttacgtagtttacggtaggtttacgggtttcgggacgggttacgggaaccgtacgggtccgttaccgggacccgtttaccggtacggtaccgtaacggtaaccccgtaacgggtccccgttaccggtccccccggtttaccggtacccgtacccggtcccgtttaccccgtttacccccgtacccctttaccccgg

SEQ ID NO: 167111 - DNA, 679 bp, Homo sapiens
  misc_feature: GYAE6OF02GF5YN.26.71.G05.1.454.CMB.1.raw
  modified_base (542)..(542): a, c, t, g, unknown or other
  misc_feature (542)..(542): n is a, c, g, or t
tcagagactatactcacgaccggtgctcgatttagtgtcgtcgcaagagagaggggcctcaggagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagactaaagttgggatatagaatgactgcctggtattaccgagtacggccaggccacgttccccgttattttcgggtactacttccttaccaagtagtaagaacggccggtccctacggagggaccttcccgtacggtaaccgtaatttccgtcggccttaccgaaccgttacgtacgggaaacctacgacgtcccaacttccgtacgtaacccgattccgaccgggaccgggaccccaaccggtacccgaaaccgggtagttcggaacgggacgtaacgtacgttaacgttcggtacgacgggtcgtaggggaactagtacgttnttagggttagttgtttcgggacggtacgtacgcggtacgtcgtaccgttacgtacggtacgacggtaccctaagggtcccgtaccgtccccgtacggtcctaacccgttccgtacccgttacccctcccgttacccg

SEQ ID NO: 167112 - DNA, 681 bp, Homo sapiens
  misc_feature: GYAE6OF02GID6S.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccaccatcacctgctcggcagacaaacgttggganatacgaaatgactcgctggtattaccgagaggccaggcctagtccccttagttttcggactattccttaccgaagtataaacggacggtccgggcccttacgacgggtactccccgtgaacccgtaatttcgtcggaccttaccaacttcgtacgggaactacgacgcccactcgtacgaccagtcgacgccgggtaccacggccgaacggcgttacggacgggtacacgtacttagttacgtacgaggtccggtaggaagtaacgttacgttaacgttaggttaggttcgtttaacggggccgggttagggtacctaagggccttacgggacccggttcgtacgggttaccgtaacggtaccccgaacgggtcccgtacccggtcccccgttacgggaccctttaccggttcccggtttcccggttccccgtaccccgtttacccg

SEQ ID NO: 167113 - DNA, 777 bp, Homo sapiens
  misc_feature: GYAE6OF02GH4AC.26.71.G05.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatcccgtggccttcgatgagctgtattcacgccctaccctcgagtcgtccgtcgtaccccaggacagacncgccaccatccacncgcncggacagacaagttggaagataagaaatgcgtgtaccgtaggttacttaccgagtacggccgaggcctaccgttcccctttagtttcggtcttacgtccttaccaaagtactaaaggaacgccggtacctcgacggaccttaccgtacgtaacgttaacgtttcgtacggtaccttaccctaacgttccgtaacgggtacctaaccgaccgtaccgtaacccttccgtaaccgtaccctacgttacccggacccggggcccccggggaaccccgtacgggaccccgtaaagggtaccggtacggaaacggggtaaaccgtaacgtttaaacgtttacggttaccggtaaccgggagggttaccggacgggtaagttaaacgttaccgtttaaggtttagttacgggttaggtttccggggaacggtaacgggaccgtagggtacccgtacgggttacccgttaccggtcgtaccgtaacccggacccgtaacggttcccgaccgtccccggttacccggtcctacgtttcccggtaccccgttccccg

SEQ ID NO: 167114 - DNA, 695 bp, Homo sapiens
  misc_feature: GYAE6OF02HGEJS.26.71.G05.1.454.CMB.1.raw
  modified_base (210)..(210): a, c, t, g, unknown or other
  misc_feature (210)..(210): n is a, c, g, or t
tcagagactatactcacgaccggtgctcgatttagtgtcgtcgcaagagagagggggctgggcctcaggaagcagcatcggaggtgcctcagccatggcagtggatccctctcttcctcggcgtcttgcttactgcacaggactccggtggccttcgatgagcgtgtattcacgcccaccctgagtcgtccgtcgtcccgaggacagacncgccacactaccacgtcgcgcgacaagaacgtaaggtggaagtagaagatgctcgacgttagtactacgacggacgtacgacgtaccgtacgttccctttagttcgtactcgtaccgtacgtaataagtaacggacgtccgacgacgttttacggacctccgacgtacgttacgtcgtacgtcctaccgtacgtacgtaacgacaacgcgtaccgaccgttacaccgaccacggtacggaccgggaccccggtaaccgacccggtaacggaacggaggaaccggtaaggtaactaacgttaacgttacggttcggacgggtaacgggtacggtaacgggtaattaacggttagtttaagttcggtaaggtttcgggtaacgggacgggtacggaacgtcgtacggtaccggtacgttcggccgtacgacccgtaggacccgtcgtccccggtccgtaccgtcccgtccgttcgtacccctacccg

SEQ ID NO: 167115 - DNA, 818 bp, Homo sapiens
  misc_feature: GYAE6OF02JEM1H.26.71.G05.1.454.CMB.1.raw
  modified_base (105)..(105): a, c, t, g, unknown or other
  misc_feature (105)..(105): n is a, c, g, or t
  modified_base (136)..(136): a, c, t, g, unknown or other
  misc_feature (136)..(136): n is a, c, g, or t
  modified_base (176)..(176): a, c, t, g, unknown or other
  misc_feature (176)..(176): n is a, c, g, or t
  modified_base (248)..(248): a, c, t, g, unknown or other
  misc_feature (248)..(248): n is a, c, g, or t
tcagagactatactcacgaccggtgctcgatttagtgtcgtcgcaagagagagggggcctcaggaagcagcatcggaggtgcctcagccatggcatggatccctntcttcctcggctccttgcttactgcacaggntccgtggccttcgatgagctgacttccgagccccaccctnagtcgtcccgtcgtaccccgaggacagtacacgccaccatcgacctgactcggacaagactaagttgggaanataacgaagtgctcgccgtaggtacttaaccgaggtacggaccacggacctacgtaccccgtttatttacggtctacttaccttacccgaagtaacgtaaacgtaacggcccggtaaccctacgacgggtaacctcccgtacggtaacccgttactttacgccggtacctaacccgtacttaccggtacggaaccgtaccgaagtacccccgtaacttcccgtaacgtaccccgtaacgtaccgacccgggtacccgggtaccccaacggtaccccggaaacgggacgttaaggacgggttaactacccgtaagttacgttacgtacggacggtcggtacgggaaagttaactacgttaagttcggtttaagggttacgggtttcggtaccggggttaccgggtaaccggacgttaccgggttacgtaacccggggttaccttaaggggtcccttaacccgggaccctaacgggttccccgttacccccgggttaccccccggacggttttacccggaccctttacccgggtttacccccggttttacccccgacccggtttaaccccgg

SEQ ID NO: 167116 - DNA, 800 bp, Homo sapiens
  misc_feature: GYAE6OF02G32PQ.26.71.G05.1.454.CMB.1.raw
  modified_base (241)..(241): a, c, t, g, unknown or other
  misc_feature (241)..(241): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttgatggagctgattcagccaccctcagtcgtccgtcgtccccgaggacagacacgccaccactccacctcgctcggcaagaactaagtgggaanagtaagaatgactcgctaggtactaccaggacgccgaggcctacggttccccttagtttcgactacgtccttaccgaaagtacgtaaagacggcccggccctagacgggtaccttcccgaagtacccgtaaagtttccgcggtacccttaccgtaaaccgttggtaaccgggaaacctacgtaccgaccctaacttccgaaccgaacctacggtaccggaacgggtccccggggaccccaaagtccccgggaaacggaagtacgggaacgggaactaaaccgttactacgggttcgacgggtaacgggtacgggtaggtaaaccgttaacttaacggtttaagtttacgggtttaacgggtttcggggttacgggtaaccgggggttaaaccgggtacggtacgggtacccgttaccggggtaacccgttcccggtaaacgggttaccggaacccgggttaacccggaacgggttcccccgttacccggtaccccccgggttacgttacccgtacccgttttccggtaaccccccgtttccccgtacctttaaccccgg

SEQ ID NO: 167117 - DNA, 685 bp, Homo sapiens
  misc_feature: GYAE6OF02HRGVM.26.71.G05.1.454.CMB.1.raw
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgcttccgtctctggtattctcacctccaccacgactggaggtgaatggtggccgtcgggtcccgtcgaccgggacccccggaaaggtccccgtgggacggttggctttcggcctacttctacgttttaacgtgggtagtcggtattccgtacgaacgggccggttaacgtaacgttccgttcctacgtaggaagaacgtaccgactaccaccactaccaacgacggaccacctaccgaaacggtcggtcgtactacagtccaacgtanagtnactcgtagtacgacagacgacaactattacttagtcgcgacaacgacgtactaccgcgtaccggacgtaacgcgggtaaaaagaaaacgtatttaaccgaggttaacgttacgggtcgggggtaaccgtaaggggttttaacgtttaccggtacccgtacccggtttaccctacccccgtacccggtcccttaaccccggacccgtaaaccccggggg

SEQ ID NO: 167118 - DNA, 856 bp, Homo sapiens
  misc_feature: GYAE6OF02JBMPJ.26.71.G05.1.454.CMB.1.raw
  modified_base (167)..(167): a, c, t, g, unknown or other
  misc_feature (167)..(167): n is a, c, g, or t
tcagagactatactcacgaccggtgctcgatttagtgtcgtcgcaagagagaggggctgggcctcaggaagcagcatcggaggtgcctcagccatggcatggatccctctcttcctcggctccttcgtctactgtcacaggatccgtcggccttccagtgagctgtnttactacgccacccctcctagtcggtccgtcgtccccacggacacgacacgccacccatccgacctcgcctccggcacgaccaaagttagggcgaactagaaatagctacgccgtcggttagttaaccacggaacggaccgacggacccgaccgtaccccgttacgtttttagttccgaacttccgttacctaacggaagttaaacggaaacggccggtaccccgtccgtaagggggtacctacccgtacccgtaccggtaaaccttttcgtaaccggttccggtaccttaaaccccgaccgttagggtaaaccccgaacttaccggacttaaccccttacgtaccggaaccctacgtaaccggtaccgggaccggggacccccgtaaccggaaccggtaaccgggtaacggacggtaccggggtaaacgtaaccggttaaccgttaacggtttcgtaccggaacgggtaccgggtgggttaaacgtaaacgttaacgtttacgtttaggttaaggtttcggggtttacgggtaccggggaacggttaacccgggacggaccgtttcggtaacccggttcccggtaacgggtttacccaaccggttaacccgaaccgggtaccgttcccgggttacccccgttaccgggttcccctacccggtttacccttcccgggtttaacccccgg

SEQ ID NO: 167119 - DNA, 631 bp, Homo sapiens
  misc_feature: GYAE6OF02HESNY.26.71.G05.1.454.CMB.1.raw
  modified_base (90)..(90): a, c, t, g, unknown or other
  misc_feature (90)..(90): n is a, c, g, or t
  modified_base (247)..(247): a, c, t, g, unknown or other
  misc_feature (247)..(247): n is a, c, g, or t
  modified_base (353)..(353): a, c, t, g, unknown or other
  misc_feature (353)..(353): n is a, c, g, or t
tcagagactatactcacgaccggtgctcgatttagtgtcgtcgcaagagagagggggctgggcctcaggaagcagcatcggaggtgcctnagccatggcatggatccctctcttcctcggcgtccttgcttactgcacaggatccgtggccttcgatgagctgattcagcccaccctcagtcgtccgtacgtccccaggacagaccagcccaccatccactgctcggcaaggactaaagttgggaanagtaagaatgctgccttggtataccgaggacgccaggccacgttccctagtttcgatactctacaagataagacgcgcctcgacggtactccgtagaactacttcnggtcctaccaactcgtacggactacgactccctagtctcgactactccggacgggccgggacccaacggacccgaaggtacggtacggaagggtaccacgttaacgttcgttacgcgaggtcggtagggaacgtaatacgttagttagtggttacgggttagggacggtacggcgtaggccgtacgtacggtaccggtacggtacgaccggtacccgtacggtaccgttccccggtaccccgtccggtaccctaccgttcccgtacccgttacccccg

SEQ ID NO: 167120 - DNA, 691 bp, Homo sapiens
  misc_feature: GYAE6OF02HB094.26.71.G05.1.454.CMB.1.raw
  modified_base (188)..(188): a, c, t, g, unknown or other
  misc_feature (188)..(188): n is a, c, g, or t
  modified_base (241)..(241): a, c, t, g, unknown or other
  misc_feature (241)..(241): n is a, c, g, or t
  modified_base (384)..(384): a, c, t, g, unknown or other
  misc_feature (384)..(384): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtntccccaggcagacagccacatccacctgactcggcacgaacaaagttcggganataagaaatgctagcctaggtattaccagtaggccaggccagtccccttagtttcgcattcttaccaagataagaacgccggacccttacgacgggactccgtagaaccgtaacttcgcggcctacctaactcgtaggaacanacgccactcgtacgaccagtccacgggaccggccccgaagtacccgaaaggacgtacgggaacggacggtaaccttaacgttacgttacggtaccgacgggttaaccgggtagggtaacggtaaacgttaaacgttacgtttaagggttaacgtttcgggttttacggggacggggtaaacggtaacccggagggtacccgtagggtacccggtaccgttagggtaccgtaacggcccgttaaacggtccgttaccggtaacccccggttccgggtaaccctacgttaccggtacccgttccccccg

SEQ ID NO: 167121 - DNA, 715 bp, Homo sapiens
  misc_feature: GYAE6OF02H03IJ.26.71.G05.1.454.CMB.1.raw
  modified_base (171)..(171): a, c, t, g, unknown or other
  misc_feature (171)..(171): n is a, c, g, or t
  modified_base (338)..(338): a, c, t, g, unknown or other
  misc_feature (338)..(338): n is a, c, g, or t
tcagagactatactcacgaccggtgctcgatttagtgtcgtcgcaagagagaggggggactcctgtgccccacatggacacgctttgctccacgctcctgctgctgaccatcccttcatgggtcttgtcccagactcaccttgaacggagtctggtcctgcgctggtggcncccacgcacgacccctcacggctcgacctgccgtcccgtctcgttggacttctccactcaccacgtactggaggtagattcggtcggtccgtcgggtccgtaccgaccgggcccccgggaaaggtccccgaggacgtcggcttgccgtacctctacgttttaaccgngggtacgtgtatacctacgaacggtccggtaactaacgtccgtctacgtaggacggtaactcgactcaaccgtactccaaccgacggaaccaccgtaccgaaacggtccgggtacgtaacccttacgaaactcggaaccgtactaagtacaacgttccggtacggtacgacctaacggacgacctaaacacgtttaactaccgttgacgtaccgacgttaaccacgttaccgtaccgacggtaccgttaacgaaaccggaaagtaaaacgtattacgtaacgtacgttaacgggtcggggttacctaaaggggttactttacccggacgttaccccgtaccggtacccctacgtcccgtaccgtaacccgtaccggg

SEQ ID NO: 167122 - DNA, 664 bp, Homo sapiens
  misc_feature: GYAE6OF02I4XKN.26.71.G05.1.454.CMB.1.raw
  modified_base (166)..(166): a, c, t, g, unknown or other
  misc_feature (166)..(166): n is a, c, g, or t
  modified_base (253)..(253): a, c, t, g, unknown or other
  misc_feature (253)..(253): n is a, c, g, or t
  modified_base (476)..(476): a, c, t, g, unknown or other
  misc_feature (476)..(476): n is a, c, g, or t
tcagagactatactcacgaccggtgctcgatttagtgtcgtcgcaagagagaggggggcctcaggaagcagcatcggaggtgcctcagccatggcatggatccctctcttcctcggcgttccttggcttactgcacaggatcgtggccttcgatgagctgattcancccaccctcagtcgtccgtgtcccccaagggtaccagaccagacccaccaatcgaaccctgcctacggcaacgacaaagttgggaanacttagaaattgacctgacctaggtacttaaccagacggacccaggaccccacgttcccctttagttttagccattacctacctaaggattaaacgacgaccggtcctacgtagggactcccccgtaggtacccgtaattttccgacggccttaacccaacgtcgtagggaacccagacgtaccaacttcgacaccagtccaggccgggacacgacgacggancggaggaagtactacgtaagttgacgtaggtacgtacgggaagaacgttaacttagtttacgtaacgtttgggttcgggacgggtaccgtagacggtaccgcgaaccgtgtaacggtacacggacccaacggtctacccggtacccgtcggtacccctactccgttacccggttaccccgtcctcccg

SEQ ID NO: 167123 - DNA, 859 bp, Homo sapiens
  misc_feature: GYAE6OF02FXDH7.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcggatgagctgattcacgccaccctcagtcgtccgtcgtccccaggacacgacacgcccaacctataccaccttgcctccgggacaacgaactaaagttggggaacgaagttaagaaacgtacgcttacgaccgttaggttaacttaccgaaggtaccggccgacggtaccaccgttaccccgtttagttttcggtactaccgttccttaacgaagtaagttaaacgaccggccggtaccctacggtacggggtacctccgtacggtaaccgttaactttccggtacgtcctaccgtaaaccgttcggtaacgggaaaccacgacgtaccctaacgttacccacgtaccgtacgtaccggtaccgggaccgggtacccctaacggtacccgtaaacgggtacgtaccggggtaacgggtaaccgtaaccgttaacgtacgtttaaccgggtacgtaacggggtccgggttaacgggtaaacggtaaacgtttaacgttaaggtttacggttaaccgggtttgggttttaaccggggaccgggtaaccgggtaaccgtaccgggtttacccggtacgggtaccccggttaccggttaaacgggtcctaacccgggtaccggaaccgggttccccgtaacccgggttcccccggtttaaccgggtacccttaccggtttacccccgttaccgggtttaacccccccgg

SEQ ID NO: 167124 - DNA, 721 bp, Homo sapiens
  misc_feature: GYAE6OF02HHHDK.26.71.G05.1.454.CMB.1.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggaccagacacgccaccatcacctncctcggcacgacaaattggggaanatagaaactgactgcctggtaacttaccgagacggccagggaccacggttcccccttaagttttcgggtacctaacttcctttaccgaaacgaacgttaaaggaacggtccggcccgttacgagggtacctcccgtagaacccgtaatttccgtggtcctaccgtaactcgtacgggaacaacgtacgcccaactcctacggtaaccatacgacgggtccgggcccaacggaccgaacggacgtggaacgggactaaccgtacgttaagttcggtacgagggtcggtagggtataaacttacggttatttacggttaaggttcggttttacgggacgggtaaccggggtaccgaacgggtccgtacgggtacccgtccgttaacggttaccgaaccggtaccccgtaagggtcccgtaccccggtccccggttaccggttcctaacccgttcccggttacccgttacccaacccccttcccg

SEQ ID NO: 167125 - DNA, 666 bp, Homo sapiens
  misc_feature: GYAE6OF02FR2LP.26.71.G05.1.454.CMB.1.raw
  modified_base (241)..(241): a, c, t, g, unknown or other
  misc_feature (241)..(241): n is a, c, g, or t
  modified_base (375)..(375): a, c, t, g, unknown or other
  misc_feature (375)..(375): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggaccttcgatgagctgattcagcccaccctcagtcgtccgtcgtccccaggacagacacgccaccatcacctgcgtcggcagacaaagtgganatagaatgctgctgtattaccgagacgccaggcccacgttccccttagttttcggctacttcttaccaagtaactaacggaacgccgacccgttcaacggggtacttccccgtagtaaccgttaacgttttcgnggtacctaccgaactcgtacgggaacacgtacgacctactaccgtacgaacctacgtccgaacgggtcccgggaccctacggacccgtaaacggcgtaagggacggactacttacgtacttggacgacggtacggaggacgtaacgtcgttaagtacggttagttgggtttacgacggtacggaccgttacggacgttacgtacccggtacgtaccggacaccggtaacccgtacggacccgtacccgggtcccctttacgggccctaccgtttcctacccggttcccccg

SEQ ID NO: 167126 - DNA, 729 bp, Homo sapiens
  misc_feature: GYAE6OF02FNRLO.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagaacaaattgggagataagaaatgctgcctggtataccagacggcacggccagtccccttagtttggtctactccttaaccaagaagtaaacgaacgcggtacccctcgaacgggtactaccctacgaaccggtaactttcgtacgggtccttacccaacgtccgtacggggaaaccaacgacgcccgtaacctaccgttaccgaaccaacttccgaacgggccccggggaccccaacggacccgaaacgggtacgagggaacgggtaacgtaaccgttaacttagttacgtaccgtaagggtccggtaagggtaacgtaagttaaccgttagttacggttaaggttgggtttaacgggtaccggggtaacgggaacccgtaaggggtccgttacggtacccgtaccggtttaacgggccctaacccggtaacccggaaggtcccgttacccggtcccccggttaccggtcccgtaaccgttcccgtttaccgttaacccccccg

SEQ ID NO: 167127 - DNA, 682 bp, Homo sapiens
  misc_feature: GYAE6OF02IWUZ1.26.71.G05.1.454.CMB.1.raw
  modified_base (505)..(505): a, c, t, g, unknown or other
  misc_feature (505)..(505): n is a, c, g, or t
  modified_base (586)..(586): a, c, t, g, unknown or other
  misc_feature (586)..(586): n is a, c, g, or t
tcagagactatactcacgaccggtgctcgatttagtgtcgtcgcaagagagaggggggggcctcaggaagcagcatcggaggtgcctcagcaatggcatggatccctctcttcctcggcgtccttgcttactgcacaggactccggtggccttacgatgagctagacttcgacgcccaccctcaggtcgttccgtcgtccccaggacacgacacgccaccatccaccgtgccgtccggacagaaccgtaaagttggggaacaagtaagaaatcgcctacggtccttagggttaacttaaccgacggtaacggccgaacggtcctaccggttccccttaagttttcggtacacgtttccgttacaaaggtataaacggacggcccgtaccgtacgacggtaactcccggtaacgtaaccgttatttccgtacgaccttaccaacgtcgtacggaacacgacgccactcgacgtaccagcgacggccggacctacggacgtaacggngtaggacgacgtaactagtacgttcgtacggacgtgacggaatactagttacgttggtagttcgtcgggacgacgggtacncggttacctacgaccgttcgacggttacgcgacccggaggtcccgtaccgtcccgtacgttccgtaccgttccgtttccgtacccctccgttaccg

SEQ ID NO: 167128 - DNA, 714 bp, Homo sapiens
  misc_feature: GYAE6OF02F78UO.26.71.G05.1.454.CMB.1.raw
  modified_base (214)..(214): a, c, t, g, unknown or other
  misc_feature (214)..(214): n is a, c, g, or t
tcagagactatactcacgaccggtgctcgatttagtgtcgtcgcaagagagagggggagtgactcctgtgccccaccatggacacgctttgctccacgctcctgctgctgaccatcccttcatggggtcttcgtcccagatcaccttgaaggagtctggtcctgcgctggtggagcccacgcacgaccctcacgctgacctgctccgtctctgnttctcactccaccacgactggtacggtagaagttggtcggccttcggggtccgtcgaccgggtacccccgggaaacggccccgtagggaggtacggtcgttcggcctaacttccgttaatttcgtgggtagtacgattaccgtcgaaggtccgtaactaacgttcccggtactcgtaggtaacgtaacgtccggtacctaccaaccgtactaccgaaccggaaccgggaacctaacccgaaccggtaaacgggtacccggggttacggttacctaacgaaacgtacccggaaaccgtacaacggttacgtaacgttccgtacgggtacggaaccacggtacgacctaaacgttaatacgtttacgtgtacacacgacgtaccgtacgtaccggcgacctaacggaacgaaagaactatacgtacgtaacgttacggtacgggtacgaaggttttagttaccgaccgttacccgtaccctaccccgacgtccccgtaaccg

SEQ ID NO: 167129 - DNA, 812 bp, Homo sapiens
  misc_feature: GYAE6OF02H6FEJ.26.71.G05.1.454.CMB.1.raw
  modified_base (139)..(139): a, c, t, g, unknown or other
  misc_feature (139)..(139): n is a, c, g, or t
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacnggatccgtggccttcgatgagctgattcagccaaccctnagtgtccgtntccccaggacagacagccaccatccacctgcctcggcagactaaagtggganatagaatgctgctaggtataccagagccaggtaccacgttcccttagttttcggactatccgttaccaagtactaaggacgccgggccctacggaggggtactcccgtagacccgttaacttcgtacgggccctaccggtaaccttcggtaaacgggaaccaccgtaacgcccctacgtttccgtaaccggaaccctaggttcccgaacccggggcccgggggtaacccccaacgggaccccgaaacggggtacgtaaccgggtaaacgggggtacctaaccgttttaacccgttaaacgtttccggaccggttaaggggacccgggttaacgggggaacttaaacgtttaacgttaggttttaacgggtttcgggttagggtttttaccggggacccggggaacggggttaacccgacggggttaccgtaaccgggtttaccccggtccggtaaagggtttccccggaaacgggttacccccggtaagggacccccggtttccccggtaccccccgggttcggttacccctttaacccgggttttcccggtacccccggttttaacccccc

SEQ ID NO: 167130 - DNA, 715 bp, Homo sapiens
  misc_feature: GYAE6OF02F55AF.26.71.G05.1.454.CMB.1.raw
  modified_base (228)..(228): a, c, t, g, unknown or other
  misc_feature (228)..(228): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctcagtgtccgtcgtccccagacagacagccacatcacctgctcgcagacaagtgganatagaatgctgctgtatacagacgcagccacgtccccttagtttcggctactcttaccaagaataaggaacgtccggaccctacgacgggtacctacccgtacgtaaccgtaactttccgacgtcccttaccaaccgttcgtacgggaacctacgacgaccctaccgtctacgacctagtccgacgggacccgggcccaacggacccgaaacgggtagtacgggaaagggtaaccgtaaccgtaacgtttaacgttacggtaccggtacggggtacggtagggaaacgttaacgttaacgttagttaggtttagggttacggtttacggggtacggggttaacggtaccggtacggtccggtaaccgtcccgttacggttaccggtaccggtacggtacccggaaccggtcccgttacccggttcccccggttacggtacccttcccggtcccgtttaccccggtacccccgttccccgttaacccg

SEQ ID NO: 167131 - DNA, 705 bp, Homo sapiens
  misc_feature: GYAE6OF02HEXCA.26.71.G05.1.454.CMB.1.raw
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (318)..(318): a, c, t, g, unknown or other
  misc_feature (318)..(318): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggtccttcggatgagctgacttcacgccctaccctcagtcgtccgttcgtccccgaggacagacncgccacatcactgctcgcagacaagtgganananaatgctgacctagtactaccgagacggccgacgccgtaccgtcccttagttttggtcctactctacaagtanaaggacgccgcctagacggtactccgagtaccgtaattcgcgtaccgtaccacctcggtacggaacctaacgtccgacccttaacgtcccgtaacacccgtacgtaccggacggtccccgggcccaaccggaccggtaacggacgtagggaacggtacgtaaccgttacgtttacgtacgtcgaacggtacggtacgggaaacttaacgttaaccttaggtttcgttaagggttcggtttacggggaccgggacggtaccggtacgtaacgggtccgttaacccggtaccgggtcggttaacccgaccggtcccggtaaccggtcccgttacccgggtcccccgtaacggttcccctaaccgtttcccgttaccccgttaccccccg

SEQ ID NO: 167132 - DNA, 742 bp, Homo sapiens
  misc_feature: GYAE6OF02JF2TS.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggagatagaatgctagcctggtacttaccagaggccaggccagtccccttatttggcattcctacaagataagaacgcggacccctgagggactccccgtagtaccgtaatttcgaggccttaccaaccttcgtacgggaaccacgacgtaccctacttccgtagaacccattacccgaacgggtcccggggaccccacgaccccggaaacgggtagtacgggaacgggtaacgtaaccgtattacgttcggtaccgaggggtcccggtagggaaagtaaccgttaacgttacggttaggttaacggtttgggtttacggggccgggttaacggggtaacccgtaggggtacccggttacggtaaccccggttaccgttaacggggtaccgtaacccgggtaaccccggtaacggggaccccgttaccccgggtaacccccccggtttcgggtaccccgtaccggtttccccggtttaaccccgggtttccccccggtaccccctttaaccccgg

SEQ ID NO: 167133 - DNA, 630 bp, Homo sapiens
  misc_feature: GYAE6OF02HWKOU.26.71.G05.1.454.CMB.1.raw
  modified_base (183)..(183): a, c, t, g, unknown or other
  misc_feature (183)..(183): n is a, c, g, or t
  modified_base (249)..(249): a, c, t, g, unknown or other
  misc_feature (249)..(249): n is a, c, g, or t
  modified_base (323)..(323): a, c, t, g, unknown or other
  misc_feature (323)..(323): n is a, c, g, or t
  modified_base (480)..(480): a, c, t, g, unknown or other
  misc_feature (480)..(480): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccggtggccttcgatgacgctgacttcacgcccaccctnagtcgtccgtcgtccccaggacagacagcccaccatccacctgctcggacaagaactaagtggganaatagaaatgctgctagtactaccaggacgccacgcctacgttcccttagttttcggactctcctacaagtaanaagacgcggcctacgacggtactccgagtaccgtattccgtcggtacctaccgtaactcgtacggaactacacgtcctactctacgacctagccgacgggcccgggaccacggaccgaacggagtaggaacggtactacgtaacttacgtcgtacgngggacggtaggaagtaacttacgttagtggttacggttggttacgggacggacggacgacggtcgtacgaccggtacggtacggtccgaacggtcccggtaacgtcccgtcccggaccccgtacgttcctacctccgttaccgttccccg

SEQ ID NO: 167134 - DNA, 713 bp, Homo sapiens
  misc_feature: GYAE6OF02HG9CB.26.71.G05.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgcttactgcacaggatccgtggcccttcgatgagctgattcacgccaccctcagtcgtccgtcgtccccaggacagacagccacactcacctgctcgaacagactaaagttggganagtagaatgctgcctggtacttaccagacggcctaggccacgttcccctattttggtcctagttcttaccaagataaggaacgtcggaccctgacgggtactcccgtagaaccgtatttaccgtcggacctcctaactcgacgggaacctacacgccactctacgactactcgacggtaccgggcccaacggtaccgaaccggtagacggaacgggtacgaactacgtagttgtacgaggcgggtagggtagaacgttctaaggtttagggtaggtttacgggtttcggggaacgggttacgggtacggtacggtacgttacggtacccggttaccgttacgggttaccgaacccgggtaacccggtacgggtaccccggttccccggtacccccggtttacccgggttaaccccgtacccgtttacccggtttaccccgttttacccccgttaccccccgtttaccccgg

SEQ ID NO: 167135 - DNA, 663 bp, Homo sapiens
  misc_feature: GYAE6OF02JPHU2.26.71.G05.1.454.CMB.1.raw
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (433)..(433): a, c, t, g, unknown or other
  misc_feature (433)..(433): n is a, c, g, or t
  modified_base (474)..(474): a, c, t, g, unknown or other
  misc_feature (474)..(474): n is a, c, g, or t
tcagagactatactcacgaccggtgctcgatttagtgtcgtcgcaagagagaggggcgtgggcctcaggaagcagcatcggaggtgcctcagccatggcatggatccctctcttcctcggcgtccttgctttactgcacaggatccgttggtcccttcgattgagtctgtattccaggccctaccctgacgttcgtccgttcgtaccccaggtacngacagccaacactcacctgtcctcggcanacaaagttggagatacgaattgacttcgcttacggtattaccgagcgccgaggcctacgtccccttagtttcggtcctacttcgtacaacgacttaacggaacgtcccgtccgtacgtacggggtaaccttccccggtagaccgttaactttcgacgtccgtactacgtcgtacggacactagacccncgtactacgacctatcgacggccggaccacgtacgaacgtnagggaggtactagttaccgtagttcgaccgtagtaccggtaggacgtacgtttaccgtaggtttcgttaagggttcgtttaacgggcgggtaacggacgttcggtcgtaccgttaccgagtttaacgggctacgcccgttaaggccctaccggtaccctggaccttccgttaccggttaccttaccccg

SEQ ID NO: 167136 - DNA, 685 bp, Homo sapiens
  misc_feature: GYAE6OF02G1GSN.26.71.G05.1.454.CMB.1.raw
  modified_base (233)..(233): a, c, t, g, unknown or other
  misc_feature (233)..(233): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccacatcacctgctcgcacgacaaagttggganatagaaatgactgctggtacttaacgagacgccaggccacgttcccctatttttcggcattcttacgaagtataaacggaacgccggaccctacgaagggactcccctaggacctaactttcgacggcctaccaacttcgtacggaacnccaagcctactcgtacaccganccgacggtccgggcccacggacccgaacgggctagggggacgggaacgacttaacgttacttcggtaccgacgggtacggtacgggtaacgtaacttacgttaagttagtttacggtttcgggtttagggacggggtacgggtaacccgtaggtaccgttacgggtaccggttaccgtggtaaccgacccgggaccgttaaacgggcccgtttacccggaccccggttcgttaacccgtacccggtttctaccccggttacccctaccccgtttaccccgg

SEQ ID NO: 167137 - DNA, 710 bp, Homo sapiens
  misc_feature: GYAE6OF02HEKTI.26.71.G05.1.454.CMB.1.raw
  modified_base (108)..(108): a, c, t, g, unknown or other
  misc_feature (108)..(108): n is a, c, g, or t
  modified_base (187)..(187): a, c, t, g, unknown or other
  misc_feature (187)..(187): n is a, c, g, or t
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
  modified_base (353)..(353): a, c, t, g, unknown or other
  misc_feature (353)..(353): n is a, c, g, or t
tcagagactatactcacgaccggtgctcgatttagtgtcgtcgcaagagagaggggggggcctcaggaagcagcatcggagtgcctcagccatggcatggatcccctntcttcctcggcgtctgcttactgccacaggatccgtggccttcgatcgagtctagattcagcctacctcagtctcgtcncccaggaccagacacgacctacatccactgctcganagaactaagttgggatataggaactgtcgtgctaagttacctaacnggacgtaccacggtacctacgtcccgtttattcggtaactaccttacgtaaccgaaagtacgtaacggtaacgccggttacccncgggtaacgtaccgtccgttacgaaccttacgttcgacggtacctacgtactacgtaacggaccacgcgtactactcgtaacgacagttaccgcgccgggaacaccgtacgtaacggacgtggaaacgtactaaccgtaacttaagtcgtacggaaccggtggtagggtaaacctaagttacgtagttagttaaggttcggttaacggtacgggacgggaaccgacggttcgaaccggtttaccgaccgtttaccggacgtaaccgggtaacccgtaacggtccccgttaacccgaacccggttcccgtaacccgggttaccttacccggtaacccgttcccccgtaggttaccccc

SEQ ID NO: 167138 - DNA, 564 bp, Homo sapiens
  misc_feature: GYAE6OF02FTW2H.26.71.G05.1.454.CMB.1.raw
  modified_base (214)..(214): a, c, t, g, unknown or other
  misc_feature (214)..(214): n is a, c, g, or t
  modified_base (306)..(306): a, c, t, g, unknown or other
  misc_feature (306)..(306): n is a, c, g, or t
  modified_base (439)..(439): a, c, t, g, unknown or other
  misc_feature (439)..(439): n is a, c, g, or t
  modified_base (476)..(476): a, c, t, g, unknown or other
  misc_feature (476)..(476): n is a, c, g, or t
tcagagactatactcacgaccggtgctcgatttagtgtcgtcgcaagagagaggggggactcctgtgccccaccatggacacgctttgctccacgctcctgctgctgaccatccccttcatgggtcttgtcccagatcaccttgaaggagtctggtcctgcgctggtggagcccacgcagaccctcacgctgacctgctccgtctctggattcncactcaccacgactgaggtgaatgtggcctgggtccgtcaggcccccggaaaggccctggagtgggcttgcacgtcatttactggacgttgntctcaaggcggtacatccgtctctgaggatcgactcaccatcaccagggacacctaccaaagaccgggtcggtccttacacgtagaccgacgatgaatcctagtgacaacaggacacatattacgtgtgacanacgagtcctagcggacgtaacgcgaagaaaacgtaanactagaactaggttacgggaccgagggttaagttttacggtacctaccggtccctaccccgtagcccctacccgaaccgtaacccggg

SEQ ID NO: 167139 - DNA, 702 bp, Homo sapiens
  misc_feature: GYAE6OF02FH3FD.26.71.G05.1.454.CMB.1.raw
  modified_base (178)..(178): a, c, t, g, unknown or other
  misc_feature (178)..(178): n is a, c, g, or t
  modified_base (216)..(216): a, c, t, g, unknown or other
  misc_feature (216)..(216): n is a, c, g, or t
tcagagactatactcacgaccggtgctcgatttagtgtcgtcgcaagagagagggggctgggcctcaggaagcagcatcggaggtgcctcagccatggcatggatccctctctcctcggcgtccttgcttactgcacaggtatccgtggccttcgatgagctgattcagcccaccctnagtcgtcccgtcgtaccccgaggacagacacgcccacntccacctgcctcggcagacgaagttggagataagaatgctacgcgtaggtactacgaggacggccacggtcccacgttccccttagttttacggctacttcgtaccaagtaagtaacgaacggccgtcccgtacggaacgggtacctaccccgtaggtacccgttaatttccgacggtcctaccgtaccgtacggtacggaacctacgccgtacccacttccgacgacctacgtacggaccggaccgggaccccaaccgacccgaacggtagtacggaacgggtacgtaaccttagttacgttacggacggtacgggtaggtacgggtaacgtaattaccgtttaggttacggtttaggtacgggtttacgggacgggtaccggacgtacggtccgtacgacccggtacgttacggaccggtacgaccccggttaggacccgttccggccccgttaccgtcctacccgttccgtaccctacccccg

SEQ ID NO: 167140 - DNA, 723 bp, Homo sapiens
  misc_feature: GYAE6OF02F6EY9.26.71.G05.1.454.CMB.1.raw
  modified_base (257)..(257): a, c, t, g, unknown or other
  misc_feature (257)..(257): n is a, c, g, or t
tcagagactatactcacgaccggtgctcgatttagtgtcgtcgcaagagagagggggagtgactcctgtgccccaccatggacacgctttgctccacgctcctgctgctgaccatcccttcatgggtcttgtcccagatcaccttgaaggagtctggtcctgcgcgtggtggacgccccacggcacgacccctcacgctacgacctcgcctcccggtctctggtacttctaccactaccaccacgacgtaggaggtnagtggtcggccgtcgggtccgccgaccggacccccgggaaacggtccgtgggacgtcggtcgttacggctacgtacttactttacgtaggtagtgtactcgtacgaacggtacgtaaccaccgttaccgtccgtacgtaggtaacgtacgtccgaacctaccaacctacgtaccaacggaaccggtaccaacccgtaaccggaaaccgggtaccgggtacgttacctaactaacggtcgaaccgtaactagtcgttaaccgtcgtaggtacgaacacgacgtaccaatatacttcgtagtacgaccacacgtaccgtacgtacggaccgtaccgtacggaaccgaaagaaacgtagtacgtaacggttaaacggttacgggttacggggaaccggttaacggtttagggtttaccgtaaccgttccccgttaacccgtccccggtacccgtccccgtaaaccccgg

SEQ ID NO: 167141 - DNA, 728 bp, Homo sapiens
  misc_feature: GYAE6OF02FQ10R.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtcgtccgtcgtccccaggacagacacgccaccatccacctgctcggcagacaaagttgganatagaatgctgctggtactaccgagacggccaggtccacgttccccgttattttcggtactacttcgttaccaagtaactaaggaacgccggtaccctacggacgggtactcccgtacgtaccgttaacgtttcgtacggtacctaccgtaaccttcggtacgggaaacctacgaccgtaccctacgtaccgtaccgaacctacgtaccgaccgggcccgggacccaacggacccgtaacgggtacgtacgggaacgggacgtaaccgtacgttagttacggacgtacgggtacggttacgggaacgtaacgttacgttagttaggttaacggtttcgttaacggggcgggttaacggggacctcgggtaccgtaccggacccgttacggtaccggtaccggacggtacccgtaacgggtcccgttaccccggtaccccgttcgggtaccctaccgttcccgttacccttacccccgtacctttaccccg

SEQ ID NO: 167142 - DNA, 809 bp, Homo sapiens
  misc_feature: GYAE6OF02IG0IY.26.71.G05.1.454.CMB.1.raw
  modified_base (175)..(175): a, c, t, g, unknown or other
  misc_feature (175)..(175): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagcccaccctngtcgtccgtcgtccccaggacagacagccacancacctgctcgcagacaagttgggaanatagaatgctgctgtattaccagtacggcccgtaaggccctacgttaccccgtttagttttcggtactacttctttaaccgaagtacgtaaacgacggaccggttcccctagacgggtacctccccgttaggtaaccccgttaatttccgttcgggtcctaccccgtaaacgttccggtaaaccgggtaacctaaccgtaccggacccgtaacttaccgttaacccgaaccgtacgttaacccggaccggggtacccggggacccccgtaacggaaccccgtaaaacccgggtacgtaaaccgggggtaacggggtaaacgtaacccgtttaaccggttaaacgtttcggtaaccggtaacggggtacccgggtaagggtaacggtaaacttaccggtttaaaccggttgggttacggtttagggtttaccggggacgggtacgggtaacccgtagggtcccgtaagggtaccccggtacggttacggtccgtaaccggacccggtaacggtccgcccggttaccccgtcggttcctcccgtttaccggccccgtttacccgtccccgttcccgg

SEQ ID NO: 167143 - DNA, 716 bp, Homo sapiens
  misc_feature: GYAE6OF02I7JOE.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggcgtgggcctcaggaagcagcatcggaggtgcctcagccatggcatggatccctctcttcctcggcgtcttgcttactgcacaggatccgtggccttcgatgagctgattcagcccaccctcagtcgtacccgtgtccccgaggacagacagccacatccactgcgtcgcagacaagttggganataagaatgactgaccgtgtaacttaccaggacggaccgacggccacgtccccttaggtttcgtacctattcccttaacgaagtaagtaacgtaacggccgtacccgtagacgggtacctcccgagtaacccgtaagtttccgtacggacctacccgaacttaccggtacgggaaccaactaaccggacccctaaccgtaccgtacgtaacccgtacgtacccggaccgggacccggggaccccaccggacccgaaacggtacgtacggaacgggtacgtaacgttactttaacgttcgtaccggagggtccggtaagggacgttaacgttaacgttagtttacgtagggtttacggttacggggtacggtacgggtaacgtaccggtagtacccggaccgttacggacggttacgacggtacccgacggtcccgtccgaccccgtcggtacctacccgtccgttacccgtccccg

SEQ ID NO: 167144 - DNA, 848 bp, Homo sapiens
  misc_feature: GYAE6OF02JOYAJ.26.71.G05.1.454.CMB.1.raw
  modified_base (156)..(156): a, c, t, g, unknown or other
  misc_feature (156)..(156): n is a, c, g, or t
tcagagactatactcacgaccggtgctcgatttagtgtcgtcgcaagagagaggggccgtcaggaagcagcatcggaggtgccgtcagccatggcatggatccctctcttcctcggcgtccttgcttactgtcacagatccgtggccttcgatganctgtattcagaccaccctcagtcgtccgtgtccccagtaccgagacagcctacgatcgaccttgctccggactacgaacgtaaattggggaactagtaacgaaattggcttcggccttaggtaaccgttaaccaggtaccggcccgaagggtccccgtaaccgttaccccgttttaagtttttcggtaccgtacgttaccttttaccgaaacggttacgtaaaaggaaccggttcccggaccccgttagggtaaacgggtaccttccccggttacggaaacccgttaacggttttccgtaaccggtcccttaaaccgtaacccgtttaccggtttagggaaaccgttaccgtaacgtaccccgtaaaccttcgtaccggtaacccaacggttccgacggacccggggacccgtaccggaacccgaaaccgggtacgtaacggaagggtaacgtaccgttaaaccgttagttaccgttacgtaaccggtacgggtacgggtaacgtaaacggtacttaaggtttacggtttaacgggttcgtttacgggtaacgggtacggggtaaccgtacgggtaccgtacggttacccggtacggtttaccggctaaccggggtaccggttaacggtcccgtaccgttccccgtaccggtaccgttacgtcccgtacccgtttcccgacccgtttacccg

SEQ ID NO: 167145 - DNA, 769 bp, Homo sapiens
  misc_feature: GYAE6OF02IV7HI.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcacgccaccctcagtcgtccgtcgtccccaggacagacacgccacatccacctgcctcggcacgacaagttgggaatataacgaatgctagcctggtacttacgagacggccagccacgtaccccttagttttacggctacttccgttaaccgaagtaacgttaaaggaaccggtcccgtaccccgtacgtaacggggtaccttaccccgtacggtaacccgttaatttccggtaccggtcctttaaccccgaacgttccggtacgggaaaacctaccgtaacgtacccgtaaccttccgtaaccggaccctaacgtaccggaccgggacccgggtaccccgaccggacccgggtaacggacggtacggtacggggactaaccgttacgttacgttacggtacggtacgggtacggtacggggaaacgtaacgttaacgttaggttagttacggttaggttcgggacggggtacgggaccggtaggtacccgtacgggtacccgtacggttaccggtcgtaaccggacccggtaacgggtcccgtacccgtaccccgggttccgtccgtaaccggttcccgttcccggtacccccgtccgttaacccg

SEQ ID NO: 167146 - DNA, 690 bp, Homo sapiens
  misc_feature: GYAE6OF02GSE11.26.71.G05.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccacctcagtcgtccgtcgtccccaggacagacncgccacatcacctgctcggcacgaacaagttggganatagaatgctgctgtactacagacgccagccatccccttatttggcatctcaagtanaacgagcgcctcaggctccagacctattcgtcgctaccactcgtaacggaacncagtacctactcacgacactcgaccgggaccgggtacccacgtacccgaaacggtagtacgggaaggggtaacgtaaccgttacgttaacgttcggtaacgacggggttaccggtaagggtaacgtaaacgttacgtttaaggtttaggttacgggttttacggggttttacggggaccggggtaaccgggttaaccggacgggttaccgttacccgggtaaccgtttacccgtacgggttacccgaacccgggtaccggtaaccgggtcccgttcccggtccccccgttacgggttccctaacccggttcccgtttcccggtttcccccaccggtttacccg

SEQ ID NO: 167147 - DNA, 668 bp, Homo sapiens
  misc_feature: GYAE6OF02HRC96.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtccagatcaccttgaaggagtctggtcctgcgcgtggtggacgcccacgcacgaccctcacgctgacctgctccgtctcgtgacttctcactcaccacgactgaggtgaatggtcggccgtcgggtccgtcgaccgggaccccggaaacggccgtggaggtcggtcttgctactctattacgtggtagtcgatcctacgaacgcggtaacaacgttccgtctcgtaggaagtaacgtcacctcactactccgaacgacggaccacccgtaccgaaacggccgggttgtaccttaacaacgtcgaaccgtacgactacgtaactccgtaggtacggaacaacggaacggcctaactattacgtttaccgtgtacgaccaacgacctacgtaccgtaggccgtacgtaccggacggaaagtaaaacagtaacgtacgtaacgttagggtacggggtaacggtaagggttaagttttaccgggtcccgtaaccccggttccctaccccggaccgttacccgtaccccgaacggtaaccccggg

SEQ ID NO: 167148 - DNA, 804 bp, Homo sapiens
  misc_feature: GYAE6OF02FXEKK.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccggtggccttcgatgagctgtattcacgcccaccctcagtcgtccgtcgtccccaggacagacacgcccaccactccacctgcctcggcaagacctaaagtgggacagtaagaatgcgtcgtcgtagtaactacgaggacgcgtacggacctaccgttcccgttagtttcggactacttccgtacgaaacgtaacgtaaacggaccggtacccgtaccccggtaacggtaccgggtaccttacccggtacgtaaccggttacgtttccgtcgtcccttaacctaaccgtcggtaacggaacctaccgaccgtacccttactaccgtacgaccgtaccgtaccggaccggtccccgggaacccgaccgtaacccggaacggtacggtagggaacggaaccgtaccgttacgttacgtacggtacggtcgggtacggtacgggttaacgttacgttaaaaacgtttggtttacgggttacgggtttacgggttacggggtacgggtaaccgggtacggtaccgggtaccggttaccggtaaccggttaccgggttaaccggtaccggtaacccggtacccggtaacccggtacccggttaccccggttccccggttacccgtaccccggttacccgttccccgttaccccgttaccccccgg

SEQ ID NO: 167149 - DNA, 774 bp, Homo sapiens
  misc_feature: GYAE6OF02GKACB.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgttccttgcttactgcacaggatccgtggccttcgatgagctgattcagcccaccctcagtcgtccgtcgtccccaggacagacacgccaccatccacctgcctcggacagactaaagttgggaagaataagaatgcgtgcctaggtactacgaggacggaccacggcctacgttcccttagttttcggtctacttccttaaccgaagtaactaacggaacggtccggacccttacggaacggggtacctcccgtacggtaaccggttaactttcgtacggtaccctaccgtaaccgttcggtaacggggaaacctaccgtaaccgtccctaaccgtccgtaacgacctacgtacccggacgggaccccggggacccacggaacccggaacgggtagtacgggtaacggggaaccttaacgttaacgttacgtttacggaccgggtacgggtacgggtagggtaaacgtaaacgttacgttaacggtttaggtttacgggtttacgggtttacggggacggggtaacgggaacccggtagggtacccggttacggtacccggtacgttacgggtaccgaccggtacccggaggtccccgtacccggccccggttaccggtacccctacgtttccccgtaccccgtttcccccg

SEQ ID NO: 167150 - DNA, 570 bp, Homo sapiens
  misc_feature: GYAE6OF02HBIX7.26.71.G05.1.454.CMB.1.raw
  modified_base (117)..(117): a, c, t, g, unknown or other
  misc_feature (117)..(117): n is a, c, g, or t
  modified_base (179)..(179): a, c, t, g, unknown or other
  misc_feature (179)..(179): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagagactatactcacgaccggtgctcgatttagtgtcgtcgcaagagagagggggctgggcctcaggaagcagcatcggaggtgcctcagccatggcatggatccctctcttccncggcgtccttgcttactgcacaggactccgtggccttcgatgagctgattcagcccaccctnagtcgtccgtcgtccccgagacagacngccaacntcacctgctcggcagacaagtgganataaggaangctagcctggtaactcgagcgccaggccacgtccccttagtttcggacacgttcctaccaatactaaaggacgcgcctacggaggctccngaaccttattcgngcctacacgtcgtaagaacngaccacctactcgtacgactanccggacggccggccacgacgaagagacggacgganacgttatcgtcgcgtacgnggtaggagtataccgttattggtagttggtcgggtaggacggacgtaggacctcgtacgtacggtacggaccacggaccgacgtaccgtccgacccgtctccggaacttccgtaccgtaccccg

SEQ ID NO: 167151 - DNA, 936 bp, Homo sapiens
  misc_feature: GYAE6OF02GQ9MB.26.71.G05.1.454.CMB.1.raw
  modified_base (247)..(247): a, c, t, g, unknown or other
  misc_feature (247)..(247): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggctccgtggccttcgatgagctgattcacgccaccctcagtgtccgtcgtcccaggacagacacgccaccactcacctgaccgtcggacacgaactaaagttcgggaanaacgtaagtaatagctacgtccgttaggtacttaaccgacggacggacccgacggtaccgaccgttaccccgtttacgttttcggtacctacttaccgttaccgaaacgtaagtaaacggaacgcccggtaccccgttacggaacgggtaccttaccccgttacgtaacccgttaacgtttccgtacggtaccttacctaacctaccggggggggtaacctaacgaaccgtacgtaccctaccgttcctaccggaccctacgtaccggacccggggacccggggtacccccaaccgggtaaccccggaaccggaacggtacggggaaacggggtaaccgttaaaccgttaaccggtttaacggtttaccggtaaccggttacgggggttccggggttaaacgggggtaaacgtttaaacgtttaacggtttaacggttttacgggtttacggggttttaaccggggtttacgggggtaacggggggttaaaccgggaccgggtaacgggttacccggttaacccggggttaccccggttacccgggtttaccggtaaccccggtaacccgggtaacccccggttaaaccggggttcccggtaacccccgggtttcccccggttacccggttacccgttaccccggttaccccgttccccggttttaccccccgaccccgttttaccccg

SEQ ID NO: 167152 - DNA, 630 bp, Homo sapiens
  misc_feature: GYAE6OF02FYERK.26.71.G05.1.454.CMB.1.raw
  modified_base (326)..(326): a, c, t, g, unknown or other
  misc_feature (326)..(326): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcgcagacaagtgggagatagaaatgctgcctaggtataccagacgcaggcacgtccctatttggctattctcaagataagagcgcctagacggactcccgagaccgtatttcgngcctaccactcgacggacacgacgccactctacgaccatcgacggccgggaccacgcgaacggtagtggacgggaatcctacgtagttacgacgtagggtccggtagggaactacgttaacgttgtttaggtacgtttagggtttacgggcgggtaacgggtacctagggtacccgttacgggtacccgttaccggtacggttcgtaacccgggtaccccgaacgggttacccgtcccggttccccccggtacgttacccggtacccgttcccgttaccccgttacccccgtacccgttccccg

SEQ ID NO: 167153 - DNA, 730 bp, Homo sapiens
  misc_feature: GYAE6OF02J11SW.26.71.G05.1.454.CMB.1.raw
  modified_base (134)..(134): a, c, t, g, unknown or other
  misc_feature (134)..(134): n is a, c, g, or t
  modified_base (388)..(388): a, c, t, g, unknown or other
  misc_feature (388)..(388): n is a, c, g, or t
tcagagactatactcacgaccggtgctcgatttagtgtcgtcgcaagagagaggggggcctcaggaagcagcatcggaggtgcctcagccagtggcactggactccctctcttccgtcggcgtccttgcttacncgcacgaggtactccgtggtccttccgatgacgctgtacttcgacgaccgtaccctgtacgtcgtccgttcgacccaggacacgacacgccctacacgtccacgtcggccgtacggactaagtaagtaacggttgggataagtaacggaactcgaccgtatccggttagtactaccgacgacgccgacgtcctaccgttccttagttcgactcaccgtaacgagtacgacgtacggccctcgacgttacggtcnccccgttggaacccttagtccgtcggtaaccctaccgtaacgtaccggacgtaactaccggtaccgactacctcgtacgtccgacgtacccggcggacccgggtaccgaaccggaacggaccggtcgtaaccgtacggtaaacgtacgttacgttaacgttcgtacggtacgggtaccggtaaggtaaccgtacgttaacgttaggttacggtttacggttaggttacgggtaccgggtaacggtaccgtacggtacgtcgtaccgtaccggacgttacgaccgtaccgtacgccgtcccgtccgtacgtcccgtccgttacctccttccccgtacgtaccg

SEQ ID NO: 167154 - DNA, 714 bp, Homo sapiens
  misc_feature: GYAE6OF02JXNRR.26.71.G05.1.454.CMB.1.raw
  modified_base (185)..(185): a, c, t, g, unknown or other
  misc_feature (185)..(185): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (610)..(610): a, c, t, g, unknown or other
  misc_feature (610)..(610): n is a, c, g, or t
tcagagactatactcacgaccggtgctcgatttagtgtcgtcgcaagagagagggggctgggcctcaggaagcagcatcggaggtgcctcagccatggcatggatccctctcttcctcggccgtccttgcttactgcacaggtatccgtggtccttggatgagctgattcgacgcccacccgttnagtcgtccgtacgtccccgaggacagacacgcctaccatcacctgcctcggacagacgtaagtgganatagaangctgctgtactacgagcgccacggctaccgttcccttagttcgctactcgtaccgaagtagtaaacgcgtccgtacccgtagacgggaccttccgtacgtaccgtaagttcgtcgaccttaccgacgtacgtaacggacctaacggccctaccgtacgtacgtacgaccgttacgacggacccgggtacccggcccgaaccggtaaccggtaacggtacggtacgggtaacccggtaacgtaaccgtttaacgttaacggttccggtaacggaccgggttacggtacggaacgttaaacgtcgttacggttacgttaagggttcggtttacgggacggggaaccgtaccgnggttaccggtacgtacccgttcggtaacggtaccaaccgggtcccgtaacggtccgtccccgtcccggtaacggttacccgtccgttacccgtcccgtaccccg

SEQ ID NO: 167155 - DNA, 710 bp, Homo sapiens
  misc_feature: GYAE6OF02FL12P.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgccaccctcagttcgtccgtcgtccccaggacagacagccaccatcacctgctcggcagactaagtggganataagaatgctgcgtggtactaccagacggccacggccacggttccccttattttcggactacttccttaccaagtaataacggaacggtccggtccctacgaggggtacctcccgtaggtaacccgttaagttttcgcggtacctaccctaacgttcggtacggaacctacgaccgtaccctaccgtccgtacgaacccacgtaccgaccgggtcccggggaccccgtaaccggacccgaaacgggtacggtaacgggaacggggtaacgtaaccgttaacgtttacggttacggtacgttacggggtacggtacggggtaacgttaacgttaccgtttagtttagttaaggttcgggtttacgggacgggtacgggtacgacggtcgtaccggtacccggtcgtacggtaccgacgtaccggacgccgtcccgtccccgtcgtaccctccgttccgtcccgtcccccg

SEQ ID NO: 167156 - DNA, 664 bp, Homo sapiens
  misc_feature: GYAE6OF02F2WHC.26.71.G05.1.454.CMB.1.raw
  modified_base (239)..(239): a, c, t, g, unknown or other
  misc_feature (239)..(239): n is a, c, g, or t
  modified_base (578)..(578): a, c, t, g, unknown or other
  misc_feature (578)..(578): n is a, c, g, or t
tcagagactatactcacgaccggtgctcgatttagtgtcgtcgcaagagagaggggggagtgactcctgtgccccaccatggacacgctttgctccacgctcctgctgctgaccatcccttcatgggtcttgtcccagatcaccttgaaggagtctggtcctgcgctggtggagcccacgcacgacctcacgctgacctgcttccgtctctggattctcactcaccacgactggaggtnaagtgtggccgtgggtccgtcgacggcccccggaacggccctggagtggtcttgcactctatttacgtggagtggactctacgaacggcggtaactaactcccggtactcgtaggtaaggtaactccgaacctccaacctactacccaaccggaacgggacccaacccgtaacccgaaacgggtacccgggttacgtacccttaaacgaacgtaccgaacccgactaagttacgaaactcccgtggtaccggaaccgacgtacggacctaactacttaacttacgtgtcgtacactaacgacgttaccgtacggcgtacctaacggaccgaaagaaaanataagtacgtaacgttaagggttcgggaacgtaagggttaactttcggtacctacccgtcccttaccccgtacgtcccctaacccg

SEQ ID NO: 167157 - DNA, 931 bp, Homo sapiens
  misc_feature: GYAE6OF02HF1U2.26.71.G05.1.454.CMB.1.raw
tcagagactatactcacgaccggtgctcgatttagtgtcgtcgcaagagagagggggctgggcctcaggaagcagcatcggaggtgcctcagccatggcatggaccctctcttcctcgcgtcctgctactgcacaggagtccgtcggtccgttcgagtagagctgtattacacgcccaccccttaccgaggtcgttcccggtccggttacccccgaacgggaacaacggaacctacggcccaacccaactacctaaccctacggccgttaccgggaccaagaaaccgtaaaagtttacgggggtaggaacttaaagaaaagtcggtccggttacgttacccggttaaggggttttaactttaaccggaacgggaaccgggacccggaaccgggttacccgtaaacccggttttccccccttttaaaggtttttttcgggtacctacgttacccttaacccgtaaaagtaagttaaacggaaacggcccgggtaaccccttccggaaaagggtaccctttcccgaacggttaaccggtaaaccttttcgttcggaccggttaccccaaacgttaccggttagggggaaacccaactaacggtccctaaaccgttccgttagaacccctaacgtacgtaccggacccggggaccccggaaccgaaccgaaccggtaacggtacggtaacgggaaacggtacgttaaccgttagttacggtacggtaaggtaccggttagggaacgttaaacgttaaccgttaacgttaggttacggtttcgggttacgggtacggggtaacgggtaccggaacggggttccgtaccgggttaccggtaccgtacgggttccggaaccgtaaccgaccgggtaccttcccgggtaccccgttaccggaccgttaccggttccgttacccgttccccgtaccccg

SEQ ID NO: 167158 - DNA, 602 bp, Homo sapiens
  misc_feature: GYAE6OF02FZ329.26.71.G05.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctnagtgtccgtgtccccaggacanacagccacatcacctgctcgcagacaaagtgggagatagaaatgctgctggtattaccagagccaggccagtcccctatttcgtctatcttaccaagtataagaagtccggccctcgagggactccgtacgaccgtaatttcgcgcctaccaactcgtaggaacacgagccactctcgaaccatcagccgggacccagaccgaaggtacngaagggactaaagtactagttgtacaggtacgtgggaanaagtacttagttcggtagtttggttacggacgggtacggaccagggtacgtaccggaccgtacgacggtacgacggaacccgtaagggcccgtaccggacccccgttcggtacccgtaaccgttccccgttacccgtttcccccggtaccccttacccg

SEQ ID NO: 167159 - DNA, 796 bp, Homo sapiens
  misc_feature: GYAE6OF02F63RT.26.71.G05.1.454.CMB.1.raw
tcagagactatactcacgaccggtgctcgatttagtgtcgtcgcaagagagagggggggggcctcaggaagcagcatcggaggtgcctcagccatggcatggactccctctcttcctcggcgtccttgcttactgcacaggatccgtggccttcgatgagtctgacttcacgcccaccctcagtcgtccgtcgtccccaggaccagacacgccaccactccacctgcctcggacagacaagttgggatatagaatgactgtcgtacggtacttaccgagacggccgacggcctacgttaccccttagttttcggtcctacgttccgttaccaaagtaactaagtaacggcccgaccctacgacgggtactcccgtagaacccgttactttaccgtcggtcctaccgtaaccgttccgtacgggaaaccaacaccggtccaaccgtcctagaaccctagtaccggtacgggcccggggaccccacggaacccgaacgggtacgacggggaaacgggtacgaaccgttacttacggtttacggtaccggtacgggtacgggtaggggtaaacttaacggttaaccgtttaaggttaacgggtttaggtttacggggtttaacgggccgggggttaaaccggggtccgtaaacgggttccgttaacgggtacccggttaccggttacgggtacccggaacgggttaccccggaacgggtccccgttacccgggtcccccgttaccggttcccttacccggttccgtttaccccggttacccccgtaccccgttacccgg

SEQ ID NO: 167160 - DNA, 806 bp, Homo sapiens
  misc_feature: GYAE6OF02G1B6X.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgacttcagccaccctgagtcgtccgtcgtccccaggacagacacgccacatccactgctcggcagtacaagttggganatagaatgctgccgtgtataccgagacggccacggcctacgtccccttagttttcggactacgttccttaccgaagtaacgtaaacggaacggtccggtaccccgtacggaacggggtaccttaccccggtacggtaacccgttaaagttttccgtacgggtacccttaaccctaacggttaccggttacgggaaaaccctaaccgaaccgtaccctaaccgttacgtaccgtaaccctaacgttaccggaccgggaccccggggtacccaacggaccccggtaaacgggtacggtacgggaacgggtacgttaaaccgttacgttacgtttacggtacggacgggtcgggtacgggtaaacgtaacgttaacgttaaggttaggttacgggtttacgggtttacggggaccggggtaagggaacccggtcggttaccggtaccgtaccgggttaccgttaccgggtaccgtaccgggaacccgtaacgggtccccgtacccgggttcccccgttacgggttacccctccgttacccgttacccggttccccgtaccccgttaacccg

SEQ ID NO: 167161 - DNA, 754 bp, Homo sapiens
  misc_feature: GYAE6OF02GLJXM.26.71.G05.1.454.CMB.1.raw
  modified_base (182)..(182): a, c, t, g, unknown or other
  misc_feature (182)..(182): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggactcccgtggtccttcgatgagctgattcacgccaccctnagtcgtccgtcgtccccaggactacgacacgccactactcacctgcctcggacagacgtaaagttggataataagaaagtcgcgtcgccgttaggtacttaaccgacggtaggcccgacggtccctaaccgtttccccttagttttcggcctaacgttccgtttaaccaaagtaactaaacgtaacggccccggtaccctaccggtacgggtaaccctccccggttacgaaccgttaactttccggtcggtaccctacctaacggtcgtaaccggaactacgaccaccgtacccgtctacgacctacgtacggtaccggggacccggacccgtaccggtaacccggaacgggaggttaacgggacgggtaaactaccgttactaagtttccggaaccgtaggggtacggtaaggtaaacggttaacttaggttattggttaagttcgggttacgggacgggtacggacgtacgttacggccgttaacccgcggttcggtaacacccggtaccggtacgtccgtacccggtaccccgttggaccctaccggttccgttccccgttaacccccg

SEQ ID NO: 167162 - DNA, 668 bp, Homo sapiens
  misc_feature: GYAE6OF02HATCS.26.71.G05.1.454.CMB.1.raw
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgcctccgtctcgtggattctcactccaccacgactggagtgaatgtaggcctgggtccgtcgacggcccccggaaagccctggacgtggcttgcactctatttacgtggngtgntctacgaagcggtaacactccgtctcgtaggagtactcgactcacactacaaccgacggaaccaccgtaaccgaaacggcccggggttacgttacccttaacgtaagtccggtaacccgtaacgacgtaacggtaacttcccggtagtacggacctaacgaggacctaacgtaatttacttaccttggtacaccgtaacgaccgtaacgttcccgtaagggcccggtacgtaaccgtaacggaaaagtaaaaagtaacgtaatacggtacgttaacgggtcggggaaccgtaagggttaacgttttcggaccgtacccgttccctaccccgacgtacccgtacccgtaccggaacccgg

SEQ ID NO: 167163 - DNA, 742 bp, Homo sapiens
  misc_feature: GYAE6OF02HW7KB.26.71.G05.1.454.CMB.1.raw
  modified_base (366)..(366): a, c, t, g, unknown or other
  misc_feature (366)..(366): n is a, c, g, or t
tcagagactatactcacgaccggtgctcgatttagtgtcgtcgcaagagagagggggctgggcctcaggaagcagcatcggaggttgcctcagccatggcatggatccctctcttcctcggcgtccttgcttactgcacaggatccgttgccttcgatgagctgattcagcccaccctcagtgtccgtcgtccccaggacagacagccaccatccacctgctcgcagacaaagtgggagataagaaatgactgcctggtattaccgagacggccacggcccacgttccccgttagttttcggtacacttcgtacctaaagactaaggaacgccggccctcgaaggctccctagaccgtaatttcgngtacctacctaacgtcgtagggaacaaccagaccctactcctacgacctactcgacggcccggggacccaacggcccgaaacgggtagtacgggaacgggtacaaccgttaacgtacgtttcggtccgtaaggggtaccgtaaggggaacgtaaacggttaacttaaggtttcgtttagggttacgggttttacggggacggggtaaacgggacccggtagggtaccggttaccggtaaccccgggttaccggtagggttaacccgaaccgggtaacccccgtaacggggccccgttacccgggtaccccccggtttaccggtttacccccggtttaacccgtttttcccccgggttaccccccgtttaccccccg

SEQ ID NO: 167164 - DNA, 799 bp, Homo sapiens
  misc_feature: GYAE6OF02JEAJX.26.71.G05.1.454.CMB.1.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgctttactgcacaggactccgtggccttcgatgagctgattcacgccaccctcagtcgtccgtcgtccccaggaccagaccacgcccacactccacctgcctcggcaagacaagttggganataanaagtgctgctagtacttacgagacgccgaggccacgtccccttagtttcggactntaccttacgaagtagtaacgacgccggtacctacgacgggcctacccggtacgtaaccgtacgttccgtcggtacctaccgaacgttccggtacgggaacacgtaccgaccctacgtcctaacgaccgtaactaccggacgggacccgggtacccaacgaaccccggtaaacggtaccggttaacgggaacgggttaaccgtaacccgttaacgtttaccgttaacggtaccgggttaacggggaccggttaaggggtaaactaaacggtttaacgttaacggtttaacgggtttacggtttacggggttacggggtaaccggggaccgggttaaccggtacgggtaccggtaccggttacccggttacgtaccggggtaaccgtaacccgggtaccggttaaccgggtcccgttaaccccggtaccccgggttaccgttacccggacccgtttcccgttaaccccggttccccccttaaccccggttaaccccgg

SEQ ID NO: 167165 - DNA, 786 bp, Homo sapiens
  misc_feature: GYAE6OF02IDX0D.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtcgtccgtgtccccgaggacaggacacgccaccatccacctgctcggcagaacaagttggganagtaagaaatgactcgtaccgttaggtacttaacgagacggaccgacggacctacgttccccctttagttttcggtacctacttccgtttaccgaaagtaacgtaaaggtaacggcccggtaccccgtacggtaacgggtacctaccccgtacggtaacccgtaagtttccgtacggtacctacccgtaacgtaccggttaacgggaaacctaaccgtacgtaaccctaaccgttcccgttaaccgaaccctacgttaccgaaccggggtacccggggaaccccctacggtaaccccgaaacgggtacgtaacgggaacgggtacgtaaccgtttaaacgttacgttacggtaaccggagggtacggtaacggaaggtaacgtagttacgtttaggtaggtttacggttaggggacgggtaacgggtacgtacggtcgttaccggtaccgttacggtaacggtacccgtaacggcccgttaacggtcccgtacccggtccccgtcgggtacccttaccgttccgtaacccgttccccacccgttacccg

SEQ ID NO: 167166 - DNA, 726 bp, Homo sapiens
  misc_feature: GYAE6OF02I83J7.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtcctgcttactgcacaggactccgtggccttcgatgagtctgacttcacgcccacctcagtcgtccgtcgtccccaggacagacacgccacgatccaccgtgctcggacagtaacgaattgggaatataagaatcgcgtacgaccttaggtacttacgaggacggtcacggcctaccgtacccttagtttcggactacttcgttaccaagactaagtacgccgacctcgacggtactcccggtagaaccgttacttctcggtacttaccgacgtacggtacggaactaacgtacgaccctagttaccgtacgaaccgtcgtacccgacgggtacccggggaccccaacgggaccaaacggtacggtaacggggaaccggtacgtaaccttacgttacgttacgaccggttaagggccgttaagggtaactaacgtttacgttaaggtttacggttggttaacgggttcgggaaccgacggggtactaaccggtcgttaccgaaccggttcgtaaccggtcgaaaccggttacccggaacggtccctacccggttaccccgtcggttaacccgtccggttacccgtcccgtttaccccgacccggtttcc

SEQ ID NO: 167167 - DNA, 806 bp, Homo sapiens
  misc_feature: GYAE6OF02IPTGC.26.71.G05.1.454.CMB.1.raw
tcagagactatactcacgaccggtgctcgatttagtgtcgtcgcaagagagaggggctgggcctcaggaagcagcatcggaggtgcctcagccatggcatggactccctcttcttcctcggcgttccttgcctttactgcacgaggactccgtcggccttcgaatggacgctgattcagcccaccctcagttcgttcccgtacgtccccgaaggaccacggacacgacccaaccattccgacccttgaccgtaccggactaacggactaaaaggttcggggataataacgaaattcgactcggtcgttacggttacttaccgagacggtcgaccgtacgtacctcccgtttaagtttggttaccactttacttaccgaaagtaccgtaaggaacgtccggtacccgtagtacgggtaccttaccgtaaggtacctttaacgttccgtcggtaccttaacccttacggtaccgtacgggtaacaccgtaccggtaccctacgtaccttaccgaccgtacgtaccggaccgggtcccggaacccgacggaccggtacggtaacgttacgggaaccgggtaactaacgttacggtttacttacggtacgggtaaccgggtagggtacggtaacgtaaccgtttagtttacggttaaacgtttggtttacggtaccgggtacggggaccgggtaaccgcgggtttacaacccgggttccggtacggttacacccggaccggggttaccgacctaccgggttccccgaccccgttttaggaccctttaccggttcccgtcccggtttcccc

SEQ ID NO: 167168 - DNA, 681 bp, Homo sapiens
  misc_feature: GYAE6OF02FQIYU.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagtccaccctcagtgtccgtgtccccaggacagacagccacatcacctgctcggacagacaagttggganatagaatgctgctgtatacagaggcaggccacgtcccctagttttcgtcataccttacaagaataacgaagccggcctacgacgggactcccgtagaccgtaatttccgtgcctacctaactcgtacggaacaacagaccacctctacgaccaagtccgaacggtcccggggacccaacggaccgaaaccggtacgacgggaacggggtacgtaaacgtaaccttacggtttacgtacggtagggccgggtaagggtaagtaaacgtacgttaagttacgggttagttcgggtttacgggacgggtacgggtaacccgacgggtaccgttacgggtacccggtttacgtaccgggtacggaacccggtacccgaacgggtcccttaccggtcccccggttacggtcccgtaaccgttcccgttccggttaccccccacccgttaccccg

SEQ ID NO: 167169 - DNA, 623 bp, Homo sapiens
  misc_feature: GYAE6OF02FNZ9G.26.71.G05.1.454.CMB.1.raw
  modified_base (175)..(175): a, c, t, g, unknown or other
  misc_feature (175)..(175): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagagactatactcacgaccggtgctcgatttagtgtcgtcgcaagagagagggggctgggccctcaggaagcagcatcggaggtgcctcagccatggcatggatccctctcttcctcggcgttccttgctttactcgacacaggatccgtggccttcgatgagctgattcgancccaccctcagtgtccgtgccccaggcagacagccacgatccacctgcctcganagacaagttgggaanataagaangcgtcgctggtattaccgagacgccagccacgtccctatttcgcatccttaccaaagtactaagacgtcggacccctcgaggtacctccctaggaccgtattccgtggacctaccgaacgtgtacggaaacctacgacgacccgtactccgtagaacctagtaccggacggtacccgggacccacgaccgaaagtaacgtcggaacggactaacgttactagttacggacgtacggacggnggtaanaaacgtaagttacgtgttaggttcggttaggaaccgggtgaaccgaggtactccggaaccttcggtaaggtcaaccgtcggacgcccgtccgtcccgagtaccgtaccgtccttaccgtccccg

SEQ ID NO: 167170 - DNA, 688 bp, Homo sapiens
  misc_feature: GYAE6OF02FSVOF.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggccgtccttgcttactgcacaggatccgtggccttcgatgagctgattcacgcccaccctcagtcgtccgtcgtccccaggacagaaccacgcccaccatccacctgacctcggacaagaacaaagttgggaacgataagaaatgctgccgtaggttactaccgagacggaccgaggccctaccgttccccgttattttcggtactacttccttaccgtaaagaactaaaggaacggtccggaccctacggtaacgggaccttcccgtacggtaaccgtaacgtttcgcggtacctacccgaacgtacgtaccgggaaactaccgacgtaccctaccgttcacgtacccacgtacgaccggtccgggacccacgacccgaaagtcgaggacgggaacgatactagtacgtcgagtcggtagagtacttacgtgtaagtcgtttaggttacggacgggtacgtcgaaggtccgtacggtaccgtacgtacggtacgacccggtaccgtacggcccgtacccggtccccgttacggtaccgtcccgttaccgttcccgtaccccgccccgtacccg

SEQ ID NO: 167171 - DNA, 658 bp, Homo sapiens
  misc_feature: GYAE6OF02F3CVG.26.71.G05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctctcctcggcgtccttgcttactgcacaggactccgtggccttcgatgagctgattcagccaccctcaatcgtccgtgtccccaggacagacngccaccatcacctgctcggacagtacaaagttggganataagaaatcgactcgccgttgtaacttaccgagtacggccaggacccacgttacccctagttttcgctacgttcttaccaagtactaagacgtccgccctacgagggacctccgtacgaccgttaattccgtaggtcccttaccgaacgtcgtaacgggaaacctaccgacgacccctaagttcccgtacgacctaactccggtacgggccccggggtacccaacggtaccgaaacgggtacgtcggaacgggacgtactacgttagtcgtacgaggtccgagggactaagtactagttgtagttggttcggacgggtacggacgtggtctacggtacccgtacggtacggtaccacgggaaccctacggcccgttccgcccccgttggtacccacccgttcgtcccgttacccccg

SEQ ID NO: 167172 - DNA, 719 bp, Homo sapiens
  misc_feature: GYAE6OF02GB7UG.26.71.G05.1.454.CMB.1.raw
  modified_base (118)..(118): a, c, t, g, unknown or other
  misc_feature (118)..(118): n is a, c, g, or t
  modified_base (185)..(185): a, c, t, g, unknown or other
  misc_feature (185)..(185): n is a, c, g, or t
  modified_base (233)..(233): a, c, t, g, unknown or other
  misc_feature (233)..(233): n is a, c, g, or t
tcagagactatactcacgaccggtgctcgatttagtgtcgtcgcaagagagaggggggactcctgtgccccaccatggacacgctttgctccacgctcctgctgctgaccatcccttnatgggtcttgtcccagatcaccttgaaggagtctggtcctgcgctggtggagcccaagcagaccctnacgctgacctgctccgtctcgtgacttctcactcaccacgactgagtnaatgtcggcgtcgggtccgtcgaccgggacccccggaaaggcccgtaggagtacggcttagctactactaactttacgtaggacgtgacttctacgtaaggtccggtaactaacgttcccgttactcgtaggaaggtaacttaccgacttacgaacctacgtacaaccgacgggacctaacccgtaaccgaaacgggtaccgggttacgttacccttaacaaagttaccgaaaccgtaactaacgtacgtaaacgttccgttaaggaccggaacttaacgaacggtacgaaactattaacttaacgtgtacgtacaacgtaccgtaagttacccgaaggtccggtaccgtaacggtaaccgtaaaaggaaaacgtaattacgtacgtaaccgttagggtacggggaacccgttaaggggttaacgtttaccggtaccgtacccgttccgttacccaccggttaccctaccgaacccggtaacccgg

SEQ ID NO: 167173 - DNA, 823 bp, Homo sapiens
  misc_feature: GYAE6OF02IGPL9.26.71.G05.1.454.CMB.1.raw
  modified_base (182)..(182): a, c, t, g, unknown or other
  misc_feature (182)..(182): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtntccccaggacagacagccaccatcacctgctcggcagacaaagttggagatagaaatgctgccgtgtacttacagacggccacggccacgttccccttagttttcggtacctacttccttaccgaaaggtacgtaaagaacggacccgggtaccccgttacgaacggggtaccttaccccgttacggaacccggttaaacttttccgtacgggtaccttacccaaaccgttccgttaacgggtaaaccaccgtacgaccctaccgttaccgttaccgaaccctacgtacccgacggggtacccggggacccccaaggaccccgaaacggggtacgtaacggggaacggggtaaccggtaaccgttaccgttaacggtttacggtaccggaacggggttaccgggtacggggaaacgttaaacgttaacgttaaggttttagggttacggtttaggggttttacggggacggggtaacgggaacccggtaggggtccgtaccggtaacccgggtttacgaccggggttaaccgtaccggaacccccggtacgggtaccccgttacccggttaccccccggttacgggtacccgtacccgtttacccggttccccgtttaccccccggcccgtttacccccgg

SEQ ID NO: 167174 - DNA, 733 bp, Homo sapiens
  misc_feature: GYAE6OF02HR1AA.26.71.G05.1.454.CMB.1.raw
  modified_base (241)..(241): a, c, t, g, unknown or other
  misc_feature (241)..(241): n is a, c, g, or t
tcagagactatactcacgaccggtgctcgatttagtgtcgtcgcaagagagagggggctgggcctcaggaagcagcatcggaggtgcctcagccatggcatggatcccctctcttcctcggcgtccttgcttactgcacaggatccgtggccttcgatgagctgattcagccaccctcagtcgtccgtgtcccccaggacagacagccacactcacctgctcggcaagacaaagttggganatagaaatgctgcctggtattaccgagacggccaggccacgtccccttagttttcggtcatccttccaagtataagaacgccggacctacgacgggtactcccgtagaaccgttaagtttcgtacggtcctacctaactcggtaacgggaaccaccgaacgtccctacgtcctacgacccagttacccgaacggggccccggggaccccaaaccgggacccgaaacgggtaacgtacggggaacgggtaacgtaaccttaaccgtttacgttcgtaccggacgggtcgggttaacgggaacgttaaacgtttaacgttacgttttagggttaagggttttcgggttaccgggacggggtacggaaccgtacggggtcttaccggggtacccgtaccgggttaaggtacccgtacgggtaacccggaacggtccgttccccggacccccggttggttaccctaccgtttcccggttccccgtttaaccccccg

SEQ ID NO: 167175 - DNA, 747 bp, Homo sapiens
  misc_feature: GYAE6OF02HISIV.26.71.G05.1.454.CMB.1.raw
  modified_base (624)..(624): a, c, t, g, unknown or other
  misc_feature (624)..(624): n is a, c, g, or t
tcagagactatactcacgaccggtgctcgatttagtgtcgtcgcaagagagaggggctgggcctcaggaagcagcatcggaggtgcctcagccatggcatggactccctctcttcctcggcgttccttgtcttacctgcacgaggactccggtggccttcgagtgacgtctgattcagtcccaccctcgagtcgtccgtcgtaccccgaggacagacacgccaacctactccaaccgtgccgtaccggacaacgaacgtaagttgggaacaagtaaggaaactgaccgttcgtaccgttaggttaacctaccgaaggaccggaccacggtcccttaaccgtaccccgttttaagttttcggacttacgttcttaaccgaaagtaataacgaacggtccgaccctaggacggaccttccgtacgaccgttattcgcgtacctacctaaccgtacgtacggaaccacgacacctaccgttcgtacgaacctacgtcggtaacgggccccggtaccgacggtaaccgaacggacgtaacgggacgacgtaacttacgtggttacggcgtacgggagtacgtaacgtagtctttaggtgttcgttcggttacggacggtagtacccgngttacccggtgtaacccgggtttacgtccgggtaccgtaaaccggtcgggttaacccggtcccgggtaccccgttcccgtaccggttaccccgttcggtttacccctacccggttaccccccg

SEQ ID NO: 167176 - DNA, 675 bp, Homo sapiens
  misc_feature: GYAE6OF02FMVOO.26.71.G05.1.454.CMB.1.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggtatccgtggccttcgatgagctgattcagccacctcagtgtccgtgtccccaggacagacngccacancacctgcncgcagacaaagtggagatagaatgctgctgtataccagcgcagccngtccctattcgctatctacaagataagacgacgcctcgtacggntcccgtgaccgtaatttccgtggcctaccgactccgtaggaacacgacgccctactcgtacgacctacgtcgacgggcccgggacccacggacccgaaacggtcgtaagggacgggtaacgtacctaacgttacttacggtacgtacggggacggttaggggaacgtaaacgttacgttaagtttaggttagggtttacgtttcgggggaacgggtacgggtaaccgtacggggtccggtaccggtaaccccggtccggttaacggtaccggtacccggtaaccccggtaagggttccccgttaccgggacccccccggtttacggggtaccctaaccccgttccgttaaccccgttaccccccccgg

SEQ ID NO: 167177 - DNA, 801 bp, Homo sapiens
  misc_feature: GYAE6OF02GX2JX.26.71.G05.1.454.CMB.1.raw
  modified_base (554)..(554): a, c, t, g, unknown or other
  misc_feature (554)..(554): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttcgatgagctgattcacgcccaccctcagtcgtccgtcgtccccaaggacagacacgcccaaccactaccaccgtcgcctccggacacggtaactaaaggttacggggaagtaacgtaagaaacgtcggcttacggaccgttaggttaaccttaaccgaagggaccggacccgacgggtaccctaccgttccccttaagtttttcggacctacgttccttaaccggaaagtaactaaacggacgcccgggtacccgtacggaacgggtaccttaccccggtacgtaaacccgttaacgtttccgtacggtaccctaaccgttacgtaccgtacggaacctaccgacgacctacgtacctacgacctacgtccgacgggccgggacccacggaccgaacggngtacgggacggtactacttacgtacgttcgacgtacgggtcggtagggtaactaagttacgttacggttaggttacggtttagggttacggggaacgggtacggtaacgggtacggtaccggttaccgtacccgggtttacgtaaccgggtaccgaccggtaacccggtaaccggttcccggtacccccggttcccccggttaggttacccctttccgttccccggtttaccccgttaaccccccgg

SEQ ID NO: 167178 - DNA, 700 bp, Homo sapiens
  misc_feature: GYAE6OF02FIQ0X.26.71.G05.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggactccgtggtccttcgatgagctgacttcacgcccaccctcgacgtcgtcccgtcgtcccccaggacctagacacgcccacntccacctgcctcggcagactaaagttgganatagaatcgctagcctggttaactaccgaggaccggccacggcctacgttccccttagtttcgactatctaccaagtactaagaacgccggtacccacgtacggacctccgtacgaccgttattccgcgtcctacctaacgtcggtacggaacacgccgtacctacctcacgaccactacgacggccgggacccgacgaccgaacggtacgacggacgggacgtaaccgttacgtacgttacgaccgtaggtacggtacgggtaacgttaacgtacgttacgtttagttaacggttagggttacgggacgggtaacggtaccgacgggtacgtacccggtaccggtaccggtacggtaccggtacccgtaaccggtacccggttacccggtacccgtaccccggttaccgcccccccgttaacgttcccgtacccgttaccccccg

SEQ ID NO: 167179 - DNA, 671 bp, Homo sapiens
  misc_feature: GYAE6OF02JQF2D.26.71.G05.1.454.CMB.1.raw
  modified_base (139)..(139): a, c, t, g, unknown or other
  misc_feature (139)..(139): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
tcagagactatactcacgaccggtgctcgatttagtgtcgtcgcaagagagagggggccgtcgaggaagcagcatcggaggtgcctcagccatggcatggatccctctcttcctcggcgtccttgcttactgcacaggntccgtggtccttcgatgagcttgacttcacgccacccctcagttcgtcccggtcgtccccaggaccagaccgacgcccacactccactcggcctcggcagacaaagttgggaanactaanaaatgctgcctgtactaccaggacgccgacgcctacgtcccttagtttcgtctctaccttcaagtanacgaacgcggtcctcgacggtctaccgagtaccgtattcncggtcctaccacgtacgtggaaccactacgcctatacctacgacctagtaccgacggtcccggaccgacggacccgaacggtagtacgggaacggatacccgtaagttcttacggacgtacgggtcgtaaggtacgtaacgttacgttacgttagttacgggtttgttaccgggtaacgggtaccgggaccgtagggtaccgtacggtaacccgttcgtaacggtcgtaccgtaaccgaacggtcccgtaacccgtcccgtccggtacgaccccgtttcgtaccccggtttccccgaccctcccg

SEQ ID NO: 167180 - DNA, 730 bp, Homo sapiens
  misc_feature: GYAE6OF02IDIM8.26.71.G05.1.454.CMB.1.raw
  modified_base (143)..(143): a, c, t, g, unknown or other
  misc_feature (143)..(143): n is a, c, g, or t
  modified_base (163)..(163): a, c, t, g, unknown or other
  misc_feature (163)..(163): n is a, c, g, or t
  modified_base (188)..(188): a, c, t, g, unknown or other
  misc_feature (188)..(188): n is a, c, g, or t
  modified_base (252)..(252): a, c, t, g, unknown or other
  misc_feature (252)..(252): n is a, c, g, or t
tcagagactatactcacgaccggtgctcgatttagtgtcgtcgcaagagagaggggctcggcctcaggaagcagcatcggaggtgcctcacgccagtggcagtggactccctctcttacctcggcgtccttgcttactgacanaggactccggtgtccttcgntagagtctgtatcacgcctaccctnagtctccgtcgcccaggcagacacgcctacactccactcgacgtcggacaagactaagtggganagtagaactgactgtcgtagtctacgagagcgagcctacgttccttgttacggtcactacgttaccaagtaataacggacgtccgtacctacgtacggactccacgtacgtacttcgcgttcctacctacgtacgtaccgaacaacgtacgcccttacacgtacgaacctacgacggaacccggccgggtaaccaccgggaaccgaacggtacggtacggaacggttacgtaacgttaaccgttagtacggtaacggtacgggtacggtacggtaacgttaaacgtaacgtttacgttaacggttgggttttaccgggttagggttaccggaacgggtacgtacgggtaccggttaccgtaccggtttaccggtcgggtaaaccccgttaccggaacccgttaaccgggtccccgtacccggttacccccttagggttacccctaccgggtttacccgttaccccggttacccccggg

SEQ ID NO: 167181 - DNA, 759 bp, Homo sapiens
  misc_feature: GYAE6OF02JPCYW.26.71.G05.1.454.CMB.1.raw
  modified_base (157)..(157): a, c, t, g, unknown or other
  misc_feature (157)..(157): n is a, c, g, or t
  modified_base (181)..(181): a, c, t, g, unknown or other
  misc_feature (181)..(181): n is a, c, g, or t
  modified_base (220)..(220): a, c, t, g, unknown or other
  misc_feature (220)..(220): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (456)..(456): a, c, t, g, unknown or other
  misc_feature (456)..(456): n is a, c, g, or t
tcagagactatactcacgaccggtgctcgatttagtgtcgtcgcaagagagaggggggggcctcaggaagcagcatcggaggtgcctcagccatggcatggactccctctcttccgcggctccttgcttactgccacaggctcggtgccttaggatnagtctagtattcactccccacctntacggttcgtccgtacgtccccaaggaccacgtacgacnccctaccataccgccgtgcctcggactagaactagtgggacagtacgaatggctacgtcgtagtacgtacctaggcggtaccgagtaccacgttcccttagttcgcacttactacgtaanacgtaacgcggtccgtaccncgtaacggtcttacccgtacgtacgttacttaccggtatcccgtaactcgtaacggttacggactaccactcccgtaataccggtccaaccgtaancccgaccggtccggacccgtaccgaaccggtacgtaggaaccggtagggtaaccgtacgtacgttacggtacggttaccgggaacggtcggggaaggtacgtaacgttaacggttgttacggttagggttaccggttagggtaccggacgggtacccggtaacgttccggtaaccgttaccggttacggtaaccggttacccggtaacccggtaaccgtaacccgggtccgttaacccccggttcggtaaccccggtcctaaccggttcccggttaccccgttacccgtccccgttaacccgg

SEQ ID NO: 167182 - DNA, 649 bp, Homo sapiens
  misc_feature: GYAE6OF02JI8MW.26.71.G05.1.454.CMB.1.raw
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
  modified_base (240)..(240): a, c, t, g, unknown or other
  misc_feature (240)..(240): n is a, c, g, or t
  modified_base (296)..(296): a, c, t, g, unknown or other
  misc_feature (296)..(296): n is a, c, g, or t
  modified_base (352)..(352): a, c, t, g, unknown or other
  misc_feature (352)..(352): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagtccaccctnagtgtccgtcgtccccaggacncgacaggcccaccatcacctgctcggcacgacaagttggganataagaatgctgacctgtactaccgagacgccaggccagtccccttagtttcgacntctacaagatagacgcgcctagagctacccgtgactagttctgcctacaacgtcgngaacacgactcctactctacgaccagtccgacggcccggtccaacgaccgaaggacgtacggacggacgtaccgtaacgttgttacgtaccgtacgggtaccgtaggggaactaacggttaaccgttagtttaacggttaggttacgggtttacggaccggggtacgggtaaccgacggtacgttaccggtacccggttaccgtaggtacccgaggtacccgtaaggtcccgtaccccggtaccccgtacccggttacctaccgttcccggtttacctacccccgtacccgttcccg

SEQ ID NO: 167183 - DNA, 893 bp, Homo sapiens
  misc_feature: GYAE6OF02JDJM9.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttacgatgagctagacttcacgcccaccctacgtaggttcgttcccggttcgtacccccgaaggaccaagaccgacgcccaacccactccaccgtcgccgtcggactaacggaactaaaggttaggggaacgtaacgtaagtaaaactcggtacgtacggtacccggtttaaggttaaccgttaacccgaagggtaaccgggacccgacggaccccggtaaccgtttcccccgtttaggtttttacggtacctacgttccgttaaccaaaggtaacgtaaaggaaccgtcccgggaacccttacgggacggttacccgacccttaccggaaccgtttaacgtttccgtacggtacccctaaccgtaacggttcgtaaaggaaaaccccgttagaaccccggtttacccaacgtttcccggtaaaccgtacccgtaacggttacccgggaacccggggtacccccgggggtacccccggaaccgggttaaccccggaaacgggggtataacgggaaacgggtaaccggttaaccttaaggtttacgttaccgggtaaccgtacggggacgggtaggtaaacgttaaacgtttacgtaagtttacgggttaggttcgggttacggggaccgggtaaacggtcgtacgggtccggttacggtacctacgggtacgttaccgcggacccgtacgggtcctaacccggtcccgtacggtacctccttacccggtaccgtttccccg

SEQ ID NO: 167184 - DNA, 691 bp, Homo sapiens
  misc_feature: GYAE6OF02IT4U0.26.71.G05.1.454.CMB.1.raw
  modified_base (237)..(237): a, c, t, g, unknown or other
  misc_feature (237)..(237): n is a, c, g, or t
  modified_base (376)..(376): a, c, t, g, unknown or other
  misc_feature (376)..(376): n is a, c, g, or t
tcagagactatactcacgaccggtgctcgatttagtgtcgtcgcaagagagaggggggggcctcaggaagcagcatcggaggtgcctcagccatggcatggatccctctcttcctcggctccttgcttactgcacaggatccgtggccttcgatgagctgattcagccacctcagtcgtccgtgtccccaggacagacacgccacatccacctgcctcggacagactaaagtggganataagaatgctgcctggtaactaccgagcggaccaggcccacgttccccttagttttcggacctacttcgtaccgaagtactaaacggacgccgtacccgtagaacgggtactcccgtaggtaaccgttaagtttccgnggtacctaccgaacgttcgacggaaaccacgaacgcctacgtaccgtcgacctaatccgacggtcccggaccaacgacccgaagggtacgaacggacggtaactaccgttaacgttacgttcgtaacgtgggtacggttacgggaacttaacgttacgttagttacggttaggtttgggttacggggaacggtacggtaaccggtaggtaccgtacgtaccggtcgtaacggtccgtaaccgacccgtagggtcccttaccggccccgttacggtaccgtacccttaccggtcccgtttacccgacccgtttacg

SEQ ID NO: 167185 - DNA, 746 bp, Homo sapiens
  misc_feature: GYAE6OF02HFI97.26.71.G05.1.454.CMB.1.raw
  modified_base (353)..(353): a, c, t, g, unknown or other
  misc_feature (353)..(353): n is a, c, g, or t
tcagagactatactcacgaccggtgctcgatttagtgtcgtcgcaagagagaggggggggcctcaggagcagcatcggaggtgcctcagccatggcatggatccctctcttcctcggcgtccttgcttactgcacaggctccgtggccttcgatgacgtctgattcacgcccaccctcgagttcgtcccgtcgtccccaggaccagacacgccacatccactgacctcggacaagactaagtgggaatagtagaatcgacgtcgtaccgtaggtacttaaccgagtacggcgacggaccctacggtccctttagttcgtctacgtcctaccgaagaataacgacgccgtaccncgaaggtcctacccgacgtaccgtagtttccgcgtcctaacgtacctaccggtaacggacacacgtacctcctcgtacgaaccgtcgtcgaccgggtccggacccgtaacgaccggaaccggtaggtacggaacggggactacgttaacgttaacgttcggacgttacgggtagggtaacggtaacgtaaccgttaagttacgggttttaagtacgggtttagggttaccggggtaccgggtaaacggtaccggggtacgggtaacgccggggttacccggtacgttacgggtcccgtaaccgggttacccggtaaccgtaccggtccccggtccccggttaccggcccggttaccgttccgggtaccccgttccccgtacccgttaccccgg

SEQ ID NO: 167186 - DNA, 763 bp, Homo sapiens
  misc_feature: GYAE6OF02G6JSR.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagaggggggctgggcctcaggaagcagcatcggaggtgcctcagccatggcatggatccctctcttcctcggcgtcttgcttactgcacaggatccgtggccttcgatgagctgattcagcccaccctcagtgtcccgtgtccccaggacagacagccaccatccacctgctcggcagacaaagttggganatagaaatgctgcctggtacttacagacggccaggcccagttcccccttagttttcggtctacttccgttaccaaaggtataaacggaacggcccggtacccctcggaacgggaccttccccgtacggtacccgttaacttttcgtcgggtaccttaccctaaaccgttcggtacggggtaaaccaccacgtaccctacttaccgtacgaccctaacgtcccgacgggacccgggggtccccaacggtaccccggaaacgggtcgtaaggggaacgggtaaccgtaccgttaaacgtttagttaccggttaccgaacggggtccgggttaaggggaacgttaaacgttaacgtttacggttacggtttaagggttacggttttaggggaccgggtacgggacccgtacgggtccgttacggacccggttacggttaccgggtaccacgggtaaccccggacggtacccgttcccggtacccccggttcggtaccccgtaccgttccgttcccggttccccccg

SEQ ID NO: 167187 - DNA, 791 bp, Homo sapiens
  misc_feature: GYAE6OF02JPFKZ.26.71.G05.1.454.CMB.1.raw
  modified_base (150)..(150): a, c, t, g, unknown or other
  misc_feature (150)..(150): n is a, c, g, or t
  modified_base (629)..(629): a, c, t, g, unknown or other
  misc_feature (629)..(629): n is a, c, g, or t
tcagagactatactcacgaccggtgctcgatttagtgtcgtcgcaagagagaggggggactcctgtgccccaccagtggacacgctttgctccacgctcctgctgctgaccatcccttcatgggtcttgtcccagatcaccttagaaggngtctcggtcctgcgcgttggagacgcccacgccacgaccctcacgctcgacctgtcctccggtctacgtggacttctccactccaccgacgtacgtggaggtgtaagttcggtcggtccggttacgggtcccggtaccggacccggggtaacccccgggtaaacggtcccggtagggtacggtcgggtccgttcggaccttaccgttaccttaagttttaaccggagggttaacgttacgtaccgttaccgtaaccgaacggttaccggttaaacctaaccgttccgttaccgtacggttacggaacggttaaacctacccgtaactaccctaacctaaccgttaccgaacccggacgggtaacccgtaccgtaacggaaacccggttaccgggtacgtttaacctacgtacgtaccgaacgtacagttacaactccggagtacggactacggacgaacctacgtaacttacgtacgtnaccggtccaacgtacgaccgttacgaccggttaccgccgtaagaaccgaaagaaactgtaccgacgtttacggtagtaacgggttacggtacggtttaccgtttaacggccctaacccggttcctaaacccgccggttacccgtacccggaccgtaacccgg

SEQ ID NO: 167188 - DNA, 874 bp, Homo sapiens
  misc_feature: GYAE6OF02HQB0F.26.71.G05.1.454.CMB.1.raw
  modified_base (761)..(761): a, c, t, g, unknown or other
  misc_feature (761)..(761): n is a, c, g, or t
tcagagactatactcacgaccggtgctcgatttagtgtcgtcgcaagagagagggggggggcctcaggaagcagcatcggaggtgcctcagccatggcatggatccctctcttcctcggcgtccttgcttactcgcacaggactccggtcggcctttcgagtgagctagattcacgtacccaccctcaaggttcgtccggttcgtaccccgaagggaccacgaccgacgacccaaccgtactacctaccgtcgccgtccggaacaacgaaacgtaaaggttagggaagtaagttaaggaaaacgtcgtcgttcgtccgttacgggttaacttaccgaacggtaccgggacccgtaacgggtaccctacggtttacccccgtttagttttacggaccttacgttcccttaacgaaagtaacgtaaacggaccggtacccggtaccccgtaggtaacggtaccttaccccggtacgtaaccgttaacgtttcgtaccggtacctaccttaaccgtcggtaacggaccacggtacccaccgtaccgtaccgtacgacctacgtaccgtaaccggggaccccggtaaccgtaaccgggaacccgtaacgggtacggtaaacgggacggggtaaaccttaccggttaaacgttacggttacggtaaccggtacggggtaccggttaacggggaacttaaacgggttcggtttaaaggttccggtttaacgggttcggttaacggggaccgggtaacgggtaccggnggttaccgtaccgggtaccggtacgtccggtaccggtacgacccggttacgcccggtacccgttacccgtcgttcccgtacgttcccgttacccgttaccccgcccttaccgg

SEQ ID NO: 167189 - DNA, 662 bp, Homo sapiens
  misc_feature: GYAE6OF02GDVIH.26.71.G05.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtcgtccccgaggacagacagcccaccatccacctgcctcggcagacaaagtgganatagaatgctgctgtataccagcgcaggccacgtcccttatttcggctacttctaccaagataagacgccggtcctgacggtctaccgtcggaaccgtactttcgacggtcctaccgtacgtcggtacggaaaccacgaccgtcctaacgtccgtacgaccctacgtaccggacgggcccggggtaccccaacggtacccgaaacggagtacgggaacgggactaaccggttaacgttagttacggacgtacgggtacggaagggtaataaacggttacgttagtttaggtacggtttacggtacgggacgggacggtaacgcggttacgtaccggaccgttaccggtacggtacgaccggtaacccgaggtcccgtacccgtccccggtacgcctcccgttaccgtcccgttacccccg

SEQ ID NO: 167190 - DNA, 528 bp, Homo sapiens
  misc_feature: GYAE6OF02GNKRN.26.71.G05.1.454.CMB.1.raw
  modified_base (231)..(231): a, c, t, g, unknown or other
  misc_feature (231)..(231): n is a, c, g, or t
  modified_base (331)..(331): a, c, t, g, unknown or other
  misc_feature (331)..(331): n is a, c, g, or t
  modified_base (519)..(519): a, c, t, g, unknown or other
  misc_feature (519)..(519): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccacatcactgctcggcagacaaattggganatagaaatgctgcctggtattaccagagccaggccagtcccctattttggcatcttccaagataagagcggcctcagggatccctaggaccgtaatttcnggctccaactctaggaacacagccactctagaccatcagccgggcccagccaacggatcggagggacgactactattgacaggtcgtgggataatactattacgtagttgttaggcggtagggaccaggctagaccgtctaggtacacgcccaaggtcctcgcccctggtccactccgtcgttccccnccttacccg

SEQ ID NO: 167191 - DNA, 827 bp, Homo sapiens
  misc_feature: GYAE6OF02IOPZR.26.71.G05.1.454.CMB.1.raw
  modified_base (777)..(777): a, c, t, g, unknown or other
  misc_feature (777)..(777): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccggtgccttacgatgagctgattcacgcccaccctacgagtcgtccgtcgtccccgaggacagacacgaccaccatccacctgtccgtccggacaaggaacctaaacgttgggaacgtataagaaatcgcgttacgccgtagttaacttaccgaggacgaccaggacctaccggttccccttaagtttttcggacttacgttccgtaccgaaagaagtaaccggaacgccggtacccgtacggaacggtacccgttaccctaccggtaaccgttaacgtttcgtaccggccttaacctacgtacggtacggaaacgactaccgacccttacgtactaccggtacctaacgtaccggaccgggcccgggtaaccccgacggtaaccccggaacggtacgtaacggggaacgggtaacgttaacccgttacgttaacggttacgaccgggttaagggtaacccgggtagggtaaaacgtaacgttaacgtttaagtttacgggttacgggttttaggggttacgggtaacccggggaagggttaacccgtaagggtcccgtaccgggttaccgttaccggtaaccggccgtaaacccggaccctaggggtacccccggtacccgttacccccggttnacccggttacccgttaccgttcccggttacccccccgtccgttaacccgg

SEQ ID NO: 167192 - DNA, 619 bp, Homo sapiens
  misc_feature: GYAE6OF02FSIGL.26.71.G05.1.454.CMB.1.raw
  modified_base (179)..(179): a, c, t, g, unknown or other
  misc_feature (179)..(179): n is a, c, g, or t
  modified_base (234)..(234): a, c, t, g, unknown or other
  misc_feature (234)..(234): n is a, c, g, or t
  modified_base (370)..(370): a, c, t, g, unknown or other
  misc_feature (370)..(370): n is a, c, g, or t
  modified_base (559)..(559): a, c, t, g, unknown or other
  misc_feature (559)..(559): n is a, c, g, or t
tcagagactatactcacgaccggtgctcgatttagtgtcgtcgcaagagagagggggctgggcctcaggaagcagcatcggaggtgcctcagccatggcagtggatccctctcttcctcggcgtccttgctttactgcacaggatccgtggccttcgatgagctgattcagccaccctnagtgtccgtcgtccccgaggacagacacgcccaccattcacctgcctcggcgaanaacgtaaggtggaagagtaagtatcgagtcgtcgttagtaactacgaggcgacgacgcctacgtacccgttgttcgctatcctaacgaagtaacgacgacgccgtaccaggacgtctccgacttacgttacgttcncgtccaccgtagtccggtaagaccagtccaccgtacgtcgtacaacgtgtaccggacggtcccggacccgagaccggaagtcggtaaggacgtactactaacgtgttacggcgtaggtacggagttaactaacgtctagtttgacggtttgacgggcgtacggacgacgtcgtacgtccgtacgggtanaccgtacgaccggctcccggtcccgtccgtacgtcctaccggttcccgtcccccgtaccg

SEQ ID NO: 167193 - DNA, 608 bp, Homo sapiens
  misc_feature: GYAE6OF02GVNQZ.26.71.G05.1.454.CMB.1.raw
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (405)..(405): a, c, t, g, unknown or other
  misc_feature (405)..(405): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtcgtccgtgtcccaggacagacacgccaccatccacctgctcggacaagacaaagttggganatagaaatgctagccttagtactacgagacgccagccacgtcccttagttcgactactctaccaagtanaagaacgccggcctagaggtactccgagaccgtaattcgngctaccactcgagaacacganccatctcacctagtcgcggccggaccacgcgaaacggtntagaggtacacttactagttacgtacgaggtgaacggaagtattacgttatacggttaggttcggtttaggaccggtaaggcccgtaggacctacgggtacctacggttaacgccgtaaccggaccgtaaaccgggtcccacccggttaccccgttacggtacccttaccggttcttaccccgtttaccccgaccttaccccg

SEQ ID NO: 167194 - DNA, 688 bp, Homo sapiens
  misc_feature: GYAE6OF02JDY61.26.71.G05.1.454.CMB.1.raw
  modified_base (148)..(148): a, c, t, g, unknown or other
  misc_feature (148)..(148): n is a, c, g, or t
  modified_base (214)..(214): a, c, t, g, unknown or other
  misc_feature (214)..(214): n is a, c, g, or t
  modified_base (658)..(658): a, c, t, g, unknown or other
  misc_feature (658)..(658): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggngtctggtcctgcgctgggtggacgcccacgcagaccctcacgctgacctgctccgtctctgattcncactccaccacgtactgaggtacaagttggtcggtccgtgggtccgtcgaccgggacccccggaaaggccccgtggagtcgggtcttcgctactcgttaacgtttacgtggtagtgatccgtagtaacggaccggtaactaacgttcccgtactcgtaggaggtaactccgactaccgaactacctaccaccggtaacggaccctaacccgtaaccgaaacggtacccggggttacttaccttaaaccgtagtacgaaccgacagttacgtactcgtacgtacggacacgtacgacttaaacgtattaacttccgtagtcgaaccacgaacgtaccgtcgacggacgtacgtaccggaacgaaagtaaagaatacgtacgtacgttacgggtcggggaaccttagggttaacgtttccggtaacctcccgttaccgttaccccncggttaacccacccgtaacggtaacccggg

SEQ ID NO: 167195 - DNA, 755 bp, Homo sapiens
  misc_feature: GYAE6OF02GCSMS.26.71.G05.1.454.CMB.1.raw
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccagcagaccctcacgctgacctgctccgtctctggattcctcactccaccacgactgaggtnaatgtcggcctgggtccgtcgacggacccccggaaggcccgtaggagtggcttggcacgtctatttacnggacgttgacttctacaaggtccggtaacaacgttccgttctctaggaacggaatcgactccaacctagtacccaccggtaacgggaccctaacccgtaaccgaaaacggtacccggggttacggttaacccctttaacgaacgtttacggaaacccgtactaacgtacgtaacttcccgtaggtacgggtaacccacggaacggccgtaaactacttaacgtttactggtaccgacgaacctaaccgtaacgtttcccgtaagggtaccccggaaccgttaccgaaacggaaaacggtaaaaagtaacgtaccgttacgtaaccgtttaggttccgggggaacccgttaaagggggtttaacgttttttacggggtacccctaccccgggtttaccgtaccccccggtaaccggttacccccgtaccccggtaacccgggaaacccccggg

SEQ ID NO: 167196 - DNA, 782 bp, Homo sapiens
  misc_feature: GYAE6OF02IYOFZ.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacacgccaccatccacctgctcggcagacaagtgggagatagaatgctgcctggtacttaccgaggacgccgacggcccacggtccccttagtttcgctatcttaccaagtataaggaacgtccggtacccgtcgacgggtacctccccgtagaacccggttaatttcgtccggtaccttacccgtaaccgttacgtacgggaaaccctaaccgacgtacccgtacttcccgtagaaccctagttacccggacgggtccccggggaaccaacggaacccggaaacggtacggtacgggaacggggtaaccgtaaccgtacgttaggtttaccgtaccgggtacgggtaaccgggtaggggtaaaccgtaaagttaacgtttaaggttacgggtttaagttttcggggttacggggaacgggtaaccggggtaaccggtaggtacccggttacgggtaccccgggttacgtaaccggtccggaaccggtaaccccggaacggtccgttaccccgggtacccccggttcgggtacccttccccggttaccgtttacccccggttaccccccgttaccccgttaccg

SEQ ID NO: 167197 - DNA, 734 bp, Homo sapiens
  misc_feature: GYAE6OF02GBZ5O.26.71.G05.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagaggggggggccgtcaggaagcagcatcggaggtgcctcagccatggcatggatccctctcttcctcggcgtccttgcttactgcacaggatccgtggccttcgatgagctgattcagccaccctcagtgtccgtcgtccccaggacanacagccacactccaccgtgctcggcagacaaagttgggagatagaatgcngcctggtattaccgagacggcaggccacgtccccttagttttcggcatctaccaagataagacgcgaccctagacgggactcccganaacctaaactttcgtaggccttaccaaaccgttcgtaacgggaaccacgtacgacccactcgtacgaccaatccggacggcccggggtacccgaccggacccgaaaccgggtagtacgggaaacgggacgtaaccgtaacttagtttacggtacgacgggtcgggttagggaacgttaaacgttaacgtttaagttaaggttagggtttagggttttacggggaccggggttaagggaacccgggtaacggtaccggtaccggtaacccggttccgttaacggtcccggaacggtaaccccggtaaacgggtccgttacccccggtcccccgttaccgggttacccgtaacccgtttacccggttcccggtttaccccccgtaccccgtttaaccccg

SEQ ID NO: 167198 - DNA, 855 bp, Homo sapiens
  misc_feature: GYAE6OF02IROMG.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcacgccacctcagtcgtccgtcgtacccaggacacgacacgccaacctatacccacctgtccgtaccggctaacggaactaaaaggttcggggaataagtaaggtaaaacgtcgtaccgttacggacccgttacgggttaacttaaccccgaaggtaacggggacccctaacggggtaccctaacgggtttacccccgtttaaggtttttacgggtaccttaacgttccgtttaccaaagggttaaactaaaacgggaaccgtacccggtaccccgtacggaaccgggtaccgtaccccgtacggtaaccgttaacgtttccgtacggaccttaacctaacgtaccgtaacggggaacctaccgtaaccgacccgtaacgttccgtaaccgaaccctaacgtaccgggaaccgggtaccccggggaacccgaaccgggaaccggtaaaccgggaaggttacgggaacgggaaaccgtaaccgttaaccggttacgttaccgggtaaccgtacggggtaaccgttacggggtaaacgtaagttaaccgttagttacggttaggttggtttacggacgggtaccgtacgcggtacgtaccgtaccggtcgtacggtaccggctaacccggacggtcccgtaacccgtcccgttaccggtcgttacccgtccgttcccgttaccccgccgttacccg

SEQ ID NO: 167199 - DNA, 851 bp, Homo sapiens
  misc_feature: GYAE6OF02IP3X2.26.71.G05.1.454.CMB.1.raw
  modified_base (120)..(120): a, c, t, g, unknown or other
  misc_feature (120)..(120): n is a, c, g, or t
  modified_base (136)..(136): a, c, t, g, unknown or other
  misc_feature (136)..(136): n is a, c, g, or t
  modified_base (184)..(184): a, c, t, g, unknown or other
  misc_feature (184)..(184): n is a, c, g, or t
  modified_base (268)..(268): a, c, t, g, unknown or other
  misc_feature (268)..(268): n is a, c, g, or t
tcagagactatactcacgaccggtgctcgatttagtgtcgtcgcaagagagagggggctgggcctcaggaagcagcatcgggaggtgcctcagccatggcatggactccctctccttccncggcgtcttgcttacngcacaggatccgtggccttcgatgagctgtattcagacccctaccctntagtcgtccgttccgcccgagacgacgacacgaccacactccaccgtcgtcctaccggcaaggtaacctaaaggttaggggaanaataaacgtaaagtcgcgtacgtacgttacgttaactaccgaacggcggtaccgacggaccgttaccgtttaccccgttagtttttacgtctaacttacgttaccgaaagtagttaaacgacgtacccgtacgtcggtaacggtacctccgtacgacgtttacttacgtcgtaccctacgtaccgtcggtaacggaccctagccgtacctacgttacctacccgactacgcggtaacggacccgggaccgaaccgaccgtacggtaacggagggtaacccgggtaacgttaacgttaacctttacgggttacgtacggttaacgggacgggtaacgggttaacttaaagggttaacttagggttttacggtttaacgggtttcgggttaacggggtaccggggaaaccggtaaccgggtaccggggttacccgggtaccggttaacccggttaacccgggttaccggaacccgggtacccggttaaacccccgggtaacggttaccccggtttccccggtttacccgttacccgggttaccccctttaacgttttcccccccggtacccggtttacccccccg

SEQ ID NO: 167200 - DNA, 798 bp, Homo sapiens
  misc_feature: GYAE6OF02FXOVP.26.71.G05.1.454.CMB.1.raw
  modified_base (197)..(197): a, c, t, g, unknown or other
  misc_feature (197)..(197): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccaggacngacagccaccatcacctgctcggcagacaagttggagatagaaatgactgcctaggttacttaccgaggacggccacggcccacgttccccttagttttcggtctacgttaccttaccgaaagtattaagacgtccggtaccccttacgaacggggtacctccccgttacggtaacccgtaacttttaccgtcgggtacccttacccgaacgttccggtaagggtaaacctaacccgacggtacccctaacgttccctaccggtaaccctagtaccggtaaccgggcccgggggtaccccaacccggtaacccgggaaaccgggtacgttacgggaaacggggtacggaaaccgtttaccgttaagtttacggtaccgacggggtaccggttaaggggaacgtaaccgtttaacgttagtttagggtttacggttagggtttacgggaccggtaacgggtaacccgtacggggtccttaccgggtacccggtaccggttaacgggtaccgaacccgggtacccggtaacgggttccgtacccccgggtcccccgtttaccgggtcccgttacccggttccgttaccccggttacccccccg

SEQ ID NO: 167201 - DNA, 763 bp, Homo sapiens
  misc_feature: GYAE6OF02G6VDK.26.71.G05.1.454.CMB.1.raw
  modified_base (67)..(67): a, c, t, g, unknown or other
  misc_feature (67)..(67): n is a, c, g, or t
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
tcagagactatactcacgaccggtgctcgatttagtgtcgtcgcaagagagaggggggactcctgtnccccaccatggacacgctttgctccacgctcctgctgctgaccatcccttcatgggtcttgccagatcacttgaaggagtctggtcctgcgctggtgacgcccacgcacgaccctcacgctcggacctgccttccgtcttcgtggtattctcaacctaccaaccgacgtactgacgggtagaaagtggtcggtccggtcgggttccggtccaccgggtacccccgggaaacgcccgttgggagtcggtctcggacncttactactttacgcggtaggtgntctacgaacgcgtaactacgtcgtctcggtagagaactcgactacaccgaactaccaacggtacgaaccgacccgttaaccgaaaaccggtccgggttacggtaaccttaaccgtaacgtaacggacccgtaatacgtaacgttaccgtcgtacggtaacggtacaccggacgtaccagttaattacgttaacgtcgtacacctaccgtacgtaccgtacgtaccggtacgtaccggaacccgaagggtaaactaaaaagaccttaagtaagggtttaccgttacggggttaaacccgggtacggttaaacgggggttttaacttttaaccggggttaaccctaccccggtttaccccgtaccccgtaccccgggttaaccccgttaaccggtaaaccccgggttaacccccgggg

SEQ ID NO: 167202 - DNA, 825 bp, Homo sapiens
  misc_feature: GYAE6OF02GTDUG.26.71.G05.1.454.CMB.1.raw
  modified_base (115)..(115): a, c, t, g, unknown or other
  misc_feature (115)..(115): n is a, c, g, or t
tcagagactatactcacgaccggtgctcgatttagtgtcgtcgcaagagagaggggctggcctcaggaagcagcatcggaggtgcctcagccatggcatggatccctctcttccncggcgtccttgcttactgcacgaggatccgtggccttcgatgacgctgattcacgcccaccctgagtcgtccgtcgtccccaaggacagacacgccaccatccacctgcctcggacacgaacctaagttgggagaatagaaatcgcttcgccgtaggttacttaccgacggtacggaccgacggacctaccgttaccccgttaggttttcggtactacgttccgttacccgaaagtaagtaaacggaacggtcccgtacccggtaccgtaacggggacccttcccgtacggtaacccgttaactttccgtacggtccctaccgtaacgtcggtacggaacgtacacgccctacgtactacgacctactaccggacggtcccgggaaccctaccgacccggaaacgtaacgggtacggaacgggaacgtaaccgttaaacggttaccgttaacggtccggaacgggttccgggtaacgggtagtaaaccgtttaagtttcggtttaagggtttacgggtttaacgggtttaacggggacccggggtaaacgggtaacccggaggggttacccgttacggggtaccccgggtttacccggtaacgggtaacccgacccggtaaccccggttacgggtaacccgtcccccgggttcccccggttaaccggttaccctaccccggtttacccgttaccccggttacccccccgg

SEQ ID NO: 167203 - DNA, 800 bp, Homo sapiens
  misc_feature: GYAE6OF02FYOUW.26.71.G05.1.454.CMB.1.raw
  modified_base (189)..(189): a, c, t, g, unknown or other
  misc_feature (189)..(189): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (434)..(434): a, c, t, g, unknown or other
  misc_feature (434)..(434): n is a, c, g, or t
tcagagactatactcacgaccggtgctcgatttagtgtcgtcgcaagagagagggggggcctcaggaagcagcatcggaggtgcctcagccatggcatggatcccgtctcttcctcggcgtccttgcttactgcacaggactccgtggccttcgatgagctgacttcagcccacctcgagtcgtccgtntccccgaggaccagacctacgccaccaactcaccctgcctcggcagtactaaagtgggaananagtaatcgctcgccttaggtattaccaggacggtacccgnggccacggttaccccttagttttacggcctagttccttaccgaaggtaactaaacggaacggacccgggtccctacggaccgggtacttccccgacggtaacctaactttcgtcgtccaccctaacgtcgtacgggaaaccngtaccgcgtaaccttccacggtcccaagttccggaccggtacccgggccgtaaccggaccgtaaacccgagttaccgggaacgggaacggtaacccttaggttaaccggtttacgaccggttaacggggtccgtaaggggtaaacttaaaccgtttaacggttaaggtttagggtttttacgggttacggggtttacggggtacccggggttaacggggtaaccgagggtacccgttacgggtaccccgggttacggttacggtaccccggaacggttacccggtaccggggccccgttaccggttcccccgtaaccgggtttcccaccgtttccgttaacccgttcccccttacccggtttaccc

SEQ ID NO: 167204 - DNA, 685 bp, Homo sapiens
  misc_feature: GYAE6OF02G25H6.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggaccagacgacgcccaccatccacctgcctcggacagaacaagttgggagtaatagaaatgctgccgtaggtaacttaaccgagacggccgacggcccgtacgttcccctttagtttcggtacctattcctaccgaagtaacgtaaacggaaccggtccggaccccgtacgtaacgggtaccttcccgtacggtaacccgttaacgtttccgtacggccgttaacccgtaaaccgttcgtaaccgggaactaaccgacgccctacgtaccgtacgacctacgtccgacggcccgggacccacggaccgaacggagtaggaacgggacgtactacgtagttagtcggtaggcgtaggatagtacttagttgtagttggttacggacgggtacggtacgacggtcgtccgtacgtccgtacgaccgtacggaaccgacggtccgtcccggtccccgttcggtaccctccgtcccgttccttccctacccgtaccg

SEQ ID NO: 167205 - DNA, 739 bp, Homo sapiens
  misc_feature: GYAE6OF02FIWUD.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtgtccgtgtcccaggacagaccagcccaccatcacctgctcggcagacaagttggagatagaaatgctgcctggttacttaccagaggccacggccacgtccccttatttcggctatcttaccaagataagaagcgccctgacggtactcccgtgaccgtaattctgctccaacgtccgtacgggaacaccgtacgacccgtactccgagtacccaacgttacacggtccggggaccccaccggacctaaacggacgttacgggaacgggaacgaaccgttaacgtacgttcgggttacctaggggtaccggttagggggaacgttaaacgttaacgttaacgttttaggtttaacggtttacgggtttttacggggaaccggggtacggggtaacccgtaggggtacccggttaccgggttaaccccggttcccggttaaaccggggttacccgaaccgggtcccccggtaaaacgggtcccgttaacccgggccccccccggtttaaccgggttccccgtacccggttttaccccgttccccggtttaccccccccggg

SEQ ID NO: 167206 - DNA, 841 bp, Homo sapiens
  misc_feature: GYAE6OF02GAIED.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccacctcagtgtccgtgtccccaggacagacagccaccatcacctgctcggcagacaaagttgggagataagaaagtgctgccgttaggtaattaccgagtacggccacggccgaccgttacccccttagttttcggtctaacgttccttaccgaaagaactaaaggaacggccggtaccccgtacgtaacggggtaaccttaccccgtacggtaaccgttaacgttttccgtacgggtacctccctaaaccgttccggtaacggggaaaccaaccgtacgacccctacccgttaccgtaccgtaacccgtagtaccgacggggaccccgggggtacccccgaaccggtaaccccggaaaccgggtaacgtacggggaaacggggtaacggtaaccctaaacgttaagtttccggtacggtaacgggtacgggttacggggtaacgtaaacgtttaacgttaagtttaagggtttagggttttacggggtttacgggggtaacccggggtaacgggggtaacccggtaaggtacccggttacccggaacccgggttccgggtaaaccgggtaccgtacccggtaacccggaacgggtaccccgttacccggtcccccggtaccggttacccgtacccgttcccgttaacccgttacccccctacccgttacccccg

SEQ ID NO: 167207 - DNA, 659 bp, Homo sapiens
  misc_feature: GYAE6OF02JXKB7.26.71.G05.1.454.CMB.1.raw
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (427)..(427): a, c, t, g, unknown or other
  misc_feature (427)..(427): n is a, c, g, or t
  modified_base (646)..(646): a, c, t, g, unknown or other
  misc_feature (646)..(646): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtcctgtcttactgcacaggactcgtggccttcgatgagctgacttcgacgccaccctcgtagtcgtccgtcgtccccaggacagaccacgccacactcgacctgccncgnaacgtacaagttcggaananagaaactgctacggcgtacggtacttacgacgacgaccgacgtccacgttcccttagtttcggactacttccgttaccgaaagtacgtaaaggaacgccggtaccgtacgagggtactcccgtacggtacgtacttacgtcggtacctcctaacgtcgtagaacgactacgcctacnctacgacctacgtacgcggccggtaccacgaccgaacggactaggacgacgtactacgtattcgagtcggacgtagggataacgtcttagttacgttggttacgtaggacgggttaacgacgcggataccgtccggtacgtcggtacctcggaaccggttaacggtccgtcccggtaccctaccggtaccggttccctaccggttaccccggttacccncccctttaaccgg

SEQ ID NO: 167208 - DNA, 679 bp, Homo sapiens
  misc_feature: GYAE6OF02FGSR3.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacccttcagtcgtccgtcgtccccaggacagacagccaccgactcacctgctcggcagaactaattggganatagaaatgctgcctggtactaccgagacggccaggccacgttcccctagtttttcggtactagtcctttaccaagaataaacggtaacgccggccccttgaaccggggtacttccccgagtaccgtaatttcgtggacctccgaacttcgtacgggaaccacgacgacctactcgacgaccactccacgggtccgggacccacggacccgaagggtacacgggagggacgaaccgtacttacttacggtccgtaagggtcgggttaacgggtaagtaacgttaaacgtttagttacgggttaggtttggttttaaccgggacgggtaacgggacccgttaggtaccgttacggaaccgttcccgtaagtccgaacggtcccgaacggtcctcccggtacccctcggtactaccgttccgtccgtccccgtccccgttaccg

SEQ ID NO: 167209 - DNA, 776 bp, Homo sapiens
  misc_feature: GYAE6OF02IMKA8.26.71.G05.1.454.CMB.1.raw
tcagagactatactcacgaccggtgctcgatttagtgtcgtcgcaagagagagggggctgggcctcaggaagcagcatcggagtgcctcagccatggcatggatccctctcttcctcggcgtccttgcttactgcacaggatccgtggcctttcgatgagctgattcagccctaccctcagtgtcccgtcgtcccccaggacagacgacgcccacactcacccgtgctaccggcaagacctaaaaggttgggagtaagtagaaatgacgtgacccgttgttaacttaccgaaggtacggtaccgacggtcccctacgttccccccgtttaagtttttcgggtacctaacggttcctttaaacccaaaggtaactttaaaacggaaccgtacccggacccgttacggaacggggtaccttaccccgtaccgtaccgtttaaacgtttcgacggttacccttaccgaacccgttgtacgggaacacccgacgccctaacgtactcgaaccctataccgaccggccgggacccctacgaccgtaagagtacggacggaacttaaccgtacgttagtacggtacgtagggtaccggtagggtaagtaccgtttaattacgggttaagtttaacgggttgggtttaccggggacgggttaaacgggaccgtacggtccggtaccgtaccggttcccggtaatacccggacggtaacccgttaccggtccgtcccggtccccggtaacggttcctacccgtttcccgtacccggttaccccc

SEQ ID NO: 167210 - DNA, 883 bp, Homo sapiens
  misc_feature: GYAE6OF02G02GO.26.71.G05.1.454.CMB.1.raw
  modified_base (256)..(256): a, c, t, g, unknown or other
  misc_feature (256)..(256): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgttccgtcgtcccccaggacagaccacgtcccaccactccgacctcgccgtcggacacgaacaaagttcgggganaagtaacgtaatcgacgtacgtcccggttagttacgttaaccgacggaacgggtccgaacgggtacctaccggttaccccgtttacggtttttacgggttactacgtttacccttaacccgaaaaggtaacttaacggaaccgggtacccggggaccccttacgggtaaaccggggtcctttacccccgtacggtaacccgtttaaagttttccggtacggttaccccttaaccgaaacgtttccggtaacggtaaacccgaaccgtaacccgcccgttaaccgttcctaaccgtaacccgtaaccgtaccgttaaccggggaaccccgggtaccccgtaacgggtaacccggaaaccgggtacgttacgggaacgggtaaccgtaaccgttaacgttacggtttacggtaccgaacgggtacgggtacgggtaacgtaacggttaacgttaaaggtttcggtttacgggtttacgggtttacggggtacggggttaacccggaaccgggacgggttacgtaccggtaccggttaccggtacggtaccggtaccggtaccggtaacgtcccggtacccgttacccgggtccgtacccgtttaccggtccgtttaccccgttaccccg

SEQ ID NO: 167211 - DNA, 642 bp, Homo sapiens
  misc_feature: GYAE6OF02G0AFD.26.71.G05.1.454.CMB.1.raw
  modified_base (172)..(172): a, c, t, g, unknown or other
  misc_feature (172)..(172): n is a, c, g, or t
  modified_base (237)..(237): a, c, t, g, unknown or other
  misc_feature (237)..(237): n is a, c, g, or t
  modified_base (344)..(344): a, c, t, g, unknown or other
  misc_feature (344)..(344): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctnagtgtccgtcgtccccaggacagacacgccaccatccacctcgcgtcgcagaactaagttggganataagaatcgctcgcctggtaactaccgagacggccaggccacgttcccttagtttgctatcctacaagtataaggcgcgccagaggtactccgcgacgtatttcgngtactaccaactcgtagacacacgcctactctacgaccagtcgacgggcccgggacccacgaccgaacggtgtacggaacgggactaactacgttaacgtcgtacggacgggtcggaagggactaaacttcggttaagttaggttaggttggttacgggacggtaccgggtacgacggtaccgtacggacccggttacggtacggtaccgcggtaacccggtaaggtccccgttacccggtcccccgttacggttccctaaccgtttcccggtccccttaccccgttccccgttaccg

SEQ ID NO: 167212 - DNA, 795 bp, Homo sapiens
  misc_feature: GYAE6OF02JL8RH.26.71.G05.1.454.CMB.1.raw
  modified_base (136)..(137): a, c, t, g, unknown or other
  misc_feature (136)..(137): n is a, c, g, or t
  modified_base (190)..(190): a, c, t, g, unknown or other
  misc_feature (190)..(190): n is a, c, g, or t
  modified_base (322)..(322): a, c, t, g, unknown or other
  misc_feature (322)..(322): n is a, c, g, or t
  modified_base (433)..(433): a, c, t, g, unknown or other
  misc_feature (433)..(433): n is a, c, g, or t
tcagagactatactcacgaccggtgctcgatttagtgtcgtcgcaagagagagggggctgggcctcaggaagcagcatcgggaggtgcctcagccatggcatggatcccctctccttcctcggcgtcttgcttacnncacaggactccgtggccttacgagtcgagcttgattccacgtcccaacccttnacggttcggtcccgtaccgtccccgaaggacgagaccacgcccaaccactcccacctgccctacggcaagacgtaaaggttcggaagtaataaggtaatcgcctcgtccgttaaggtacctacgacggtacnccgacgtccgtaacttcccgtttaggttgtcacttctacaagtaataggaccgcggtacctggacgcctccgtagtacctacgttctacggctacgaactcggacggaacncgacgtccacttcgtaacaccacgtaccggcgggtcccggtaccgaccgggtaccgaaaggtcgtacgggaacgtacgaaccgttacgtagttaccggtacggaccgggttagggtaagggtaagttaaacccgttagggtttaacggtttcgggtttaaacgggttcggggtttaccgggtacgggggttaaaccgggtaccggggtaccggttttaccggaccgggtaacccggtttaccggttaacccgggtaacggtaaccccggtaaccggggacccgttaccccggtccccgggttttacccccgggtaccgggttaacccctttccccggttccctttaaccccccggtcccccg

SEQ ID NO: 167213 - DNA, 785 bp, Homo sapiens
  misc_feature: GYAE6OF02G851K.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccaccatccacctgctcggcagacaattggganatagaatgctgcctggtattacagacgccaggccacgtcctatttggcatctaccaagataagacgccggtaccctgacgggtactccccgtagtaccgttaatttccgcggtcctaacccgtaactccggtaacgggaaaccaccgtacgaccctaactccgtacgaaccctaatccggacgggtcccggggaccccaacggacccgaaaccggggtaacgtcggggaaacgggtacgtaaaccgttaacgtaacgtttacggtaccgggaaggggtccgtagggggtaaacgttaaagttaaccgttaaggttttacgggttaaaggttttggggtttaccggggtacggggtaaaccggggttaaccggtaccggggtaccgttacgggtaaccccgggttcgttttaacccgggaacccgtaaccgggtaccccggtaaacgggtccccggttacccccggtccccccggttaccgggttaaccccgtttacccggttaccccggtttaccccggtttaccccccgtaccccgtttaacccccgg

SEQ ID NO: 167214 - DNA, 761 bp, Homo sapiens
  misc_feature: GYAE6OF02JAQ30.26.71.G05.1.454.CMB.1.raw
  modified_base (214)..(214): a, c, t, g, unknown or other
  misc_feature (214)..(214): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatggagctgattcagcccaccctcagtcgtcccgtgtccccgaggacagacagcccacntccacctgcgtcgcagacaaagttggagactagaagtgtcgcgtcctaggttactaccgagacgggacccgaggccctaccggttccccgttaagtttcggtactacgttccttaccgaaagtacgtaaagggtaacgccgggaccctggaacggtacctccctacggtaccgtaactttccgtaggtacctaccaacgttccggacggaaaccgtcctacggaccctaccgttctaccgacccgtagttacccggaccgggaccggggccccaaccggtaccggaaacgggtacgttagggaccgggaactaaccgttagttacgttcgaccggtacgggtaacgggtagggaactaaacgttacgtttaggttacggtttaggttaccgggtttcggggacgggacccggtaacgtcgggtccgtacggttccccggttaccgtaaccggggttccctaaccgggaacccggtaccgggtaacccggtcccgggtacccccgttaccgggtaccctaccggttccccgttccccggttccccccg

SEQ ID NO: 167215 - DNA, 831 bp, Homo sapiens
  misc_feature: GYAE6OF02GJWBV.26.71.G05.1.454.CMB.1.raw
  modified_base (179)..(179): a, c, t, g, unknown or other
  misc_feature (179)..(179): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccggtggccttcgatgagctgattcacgccaccctnagtcgtccgtcgtcccgaggacagacacgccaccatccaccgtgccgtcggacaacgaacgtaaagttgggacgtaagtaagaaatgctcgtccgtagttaactaccgagacggtaccgacggacctaccgttaccccgtttagttttcggtacctacttacccttacgaaacgtaagtaacggaacgtcccggaccccgttagaccggggtacctcccgtacggaaccgttacgtttccacgggtaccctacctaacgttacggtaacggaaacctaacgacgtacccgtacctactacgaacccgtaacgtccggaccgggtacccggggaaccccgtaccgggtaacccgaaacgggtacggtacggggaaacgggaacgtaaccgttacgttaagtttacgggtaccggtacgggtacggtaaggggtaacgttaagttaacgtttaacgtttacggttagggttttcgggttacgggttaccgggacggttaaccgggaccggttacggtaccgggttaacccggtttccgggttaaccggggttaccgaaccgggttaaccccggtaacggttaccccggtcccggttacccccggttaccgggtacccttaaccggtttccccggtttaccccggttaccccccg

SEQ ID NO: 167216 - DNA, 737 bp, Homo sapiens
  misc_feature: GYAE6OF02I8K7B.26.71.G05.1.454.CMB.1.raw
  modified_base (253)..(253): a, c, t, g, unknown or other
  misc_feature (253)..(253): n is a, c, g, or t
  modified_base (359)..(359): a, c, t, g, unknown or other
  misc_feature (359)..(359): n is a, c, g, or t
tcagagactatactcacgaccggtgctcgatttagtgtcgtcgcaagagagaggggcctcaggaagcagcatcggaggtgcctcagccatggcatggatccctctcttcctcggcgttccttgcttactgcacgacggatccgtggtccttccgatgagctgattcagcccacctcgagtcgtccgtcgtaccccaggaccagtccacgccaccaatccacctgtaccgtcggacagaacgtaagttcggganataacgaaatcgtcgtacgcttacggtagttaacccgagtacgggacccaccggtacctaacggttccccctttaagtttcggtactacttaccgttaccgtaaanaaacgttaacggaaccgtccggtaccctacggtaacggaccgttacctaccggtacgtaactttcgtacggacctaccgtaacgcgtacggaactcgaccgtacctacgtacgtacacctagtccgacggccgggcccacgtaccgaacggtgtcggtagacggtacctacgtaagttcgtacgacggcggttacgggaagtaacgttaacgttacgttagtcggttacgggtttcggaccgggtcgggtaacggcggttaccgtacgttacccggtacgttaccggtactaccggtaacccgacggggtcctaacccgggttcccgtaccggttacctaccggtcccgtttaccccggtaccccttaccggttaccc

SEQ ID NO: 167217 - DNA, 681 bp, Homo sapiens
  misc_feature: GYAE6OF02FNR4N.26.71.G05.1.454.CMB.1.raw
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcagtcgtccgtgtccccaggacagaccagtccaccatccacctgctcggcagacaaagttggganatagaatgctgctagtatacagnggccaggccacgtcccctattttggcactcttacccaagataaggacgcggtcctcgaggctccgngaccgtattcgngtctcgaactcgtaggacncaacgcctactccgtacgacctagaccgtacggacccgggccctacggacccggaaaccggtagtaccgggtaagggacaacccgtttaacgtacgttttggaccgtaacgggacgggtaggggtacgtaaaacgtaccgttagtttaccggttaaggtttacggggtttcgggaacggtacggggtaacccgagggtccgtacgttacccgggtcccgttttggggaccctaacgggtacccccgaaaggggttcccgtcccggtacccccgtttaccggtaccccgtacccggttccctcccggtttacccccccg

SEQ ID NO: 167218 - DNA, 830 bp, Homo sapiens
  misc_feature: GYAE6OF02H8CFO.26.71.G05.1.454.CMB.1.raw
tcagagactatactcacgaccggtgctcgattttagtgtcgtcgcaagagagagggggggcctcaggaagcagcatcggaggtgcctcagccatggcatggatccctctccttcctcggcgtccttgcttactcgcacaggactccggtggtaccttcggatggacgtccgtggtaactttccgacgccctaaccccttcgaggttcgtccgtcgtccccaggacaaggaccacgcccaccagtccacctgctacggacaacgactaagttgggaactagtaagtaaatggactcggtaccgttaggttaactaaccgaggacggtaccgacggtccctaccgtttcccgtttaagttttccgggtacctacgtttaccgttaaccgaaaggttacttaaaacggaccgggtccccgtaccccggttaccggtaaaccggggttacccttaccccggttacgggtaaccccgtttaacgtttcccggtaccggttaccgtaacccggttaaccgttaccggtaaccggggtaacctacccgacccgggtacctaccgttaccgtaccgtaacccgtaccgtccggaacccggggcccggtaacccgtacgaacccggtaagggtaccgtggaacgggtaacttacgtacgttacgttcgacggttaggcgttacggactaacgttacgtaggttagttacgggttcggttacggggccgtaaccggttcgagggtcccgtaccgggacttaccgggtcacggcctaacccggtgtcccgttccgacccgttccgcgttacccgttcctaccggttcccccacgttacccg

SEQ ID NO: 167219 - DNA, 689 bp, Homo sapiens
  misc_feature: GYAE6OF02GX7HC.26.71.G05.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagttcgtcccgtcgtccccgaggacagacacgccaccatccacctgccncggcagacaaagttggganataagaaatgctcgccgtaggtattaaccgacggacggccgacggaccctacggttccccttagttttcggtctacttccttaccaagtaataaggaacggtccggacccgtacggacgggtacctcccgtacgacgttaacttcgtcggacctacgtaaccgtcggtacggaacacgacgacctactcgacgtaccagtaccgacgggcccgggaccctacggacccgaagggacgagggaccgggactaaccgttacgttacgttacggttacgaacgggtaggtacgggaacgttaaattaccggttagttcgttaaggtttgggttacgggacggtaacgggacgtacggcgttaccggtaccgttcggtacggtccgaaccgtcccggaacgtcggtcccgttcccggtccgggactccgttcggttcccctaccccg

SEQ ID NO: 167220 - DNA, 739 bp, Homo sapiens
  misc_feature: GYAE6OF02JFMVX.26.71.G05.1.454.CMB.1.raw
  modified_base (264)..(264): a, c, t, g, unknown or other
  misc_feature (264)..(264): n is a, c, g, or t
  modified_base (481)..(481): a, c, t, g, unknown or other
  misc_feature (481)..(481): n is a, c, g, or t
tcagagactatactcacgaccggtgctcgatttagtgtcgtcgcaagagagagggggggcctcaggaagcagcatcggaggtgccctcagccatggcatggatccctctcttcctcggcgtccttgcttactgcacgagatccgtggccttgattgacgctgacttcgacgcccaccgtcaggtcgttcccgtagtccccgaaggccaacgaccgacggccctacacgtaccgcctcgactccgggacagtaacaagttggganaactaagatcgctacggcgtagtacgtaaccgacggtagaccgaggacctaaccgttcccgtttaacgttttcgggaacttacgtaccgttaccgaagtacgttaaacggaaccggtccccggtccgtacggtacgggtaccttacccgtaccgtacgttaccgttcggtaccggcttacccgaacttcggacggaaacttcgaccgtaccttaacncgtacctacgacttaccggaccggtacccgggacccacgtaacccgacggagtggtaacggtacctaacgttaccgttagttaccggaggtacggtcggtaaaggaaccgttacgttaacgttcgggttagtacgggtttcggttaacgggcggtaacgggcctaggtccgtacggtacccgtgtaaccgtccggaccgtaccggactcccgttcccgaccgttaccgctaccgtccttaccggaccctcggtaaccg

SEQ ID NO: 167221 - DNA, 1126 bp, Homo sapiens
  misc_feature: GYAE6OF02I5FS0.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctctccgtcggtcttcgtcgtcttactgacacgaggtactccggtcggtccttacgagtagacgtctagtacttccgacgccctaccctcgtggtccggtccgttcccgtacccgacggacacgaccgacgacccaacctacgtacctaaccgtcgtaccgtccggacaacggtaaaccgttaaagggttacggggaactaaaggtaaaggtaacgtcgtacggtaccgtaccggttaacggtttaacctaaccggacggggaaccgaccgggaaccgggtaccccttaacccgggttttaccccgtttttacgggttttaccggtaccctttacctttaaccctaaaccggtaaaagtaacgttaaaccgggtaaccgggaccccgggttaccccgtaaggggtaccccggttaaccctaccccgggttaaccggttaaacccggttttaacgtttcccgggtaaccgggttaccccttaacccggtaaaacggttcccggtaaaaccgggtaacccctaacggtaccccgaacccttaacggttaccccgaaccggttaaccctaaccgggcccgggggtaaaccccgggggaccccggggtaaaccccgaaccgggaaacccgggtacgggtaaaccgggttagggggaaaaccggtaaccccggtttaaactttaccggtttagggttaacccgggtaccgggtacgggtaaccggggtaacgggttaaacgttaaaccgttttacggtttacgggttttaacgggtttaaccggggtttgggggttaacccgggggtaaccggggtaacccgggtaaccggggttaaccgggttacccgtaacccgggggttacccggtttaacccggggtaaacgggtttaccccggaaacccggggaaccccggttaccggggttacccccccggttaacccccggggggttccccgttaccggggttaaccccccctttacggttttaccccccgtttaccccccggttaaccccccgg

SEQ ID NO: 167222 - DNA, 685 bp, Homo sapiens
  misc_feature: GYAE6OF02HJD4X.26.71.G05.1.454.CMB.1.raw
  modified_base (178)..(178): a, c, t, g, unknown or other
  misc_feature (178)..(178): n is a, c, g, or t
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (453)..(453): a, c, t, g, unknown or other
  misc_feature (453)..(453): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggacttccgtcggccttcgatggagctgattcacgcccaccctnagtcgtccgtcgtaccccaggacagcacgcccaccatccgacctcgccttaggactacgaanaaggttgggaanaataacggaaatcgcttgtccgttagggtacttaaccgaggacggtaccgaggccctacggttaccccttagtttcgacttactcctttaccgaaagtacgtaacggacgtccggaccctacgagggtaccgtccccaggttaccttaacgtttccgtacgggtaccctcgtaaaccgtcgtaacgggaacctacggaacnccctaactcgtacgacgtcgacggacccgggcggtaccccaggtaaccgacgtcgtaggaggtacagtactagtcgtacggcgtacgtaggactaatacggttgttcgtaggttacgtggtacgggtacggacggtacggacgtacggaccgtacgtaaggtcccgaaacggtccggacttcggaccccgttccgacgttccgaccttcccgtacccgtaccctcctcccgg

SEQ ID NO: 167223 - DNA, 619 bp, Homo sapiens
  misc_feature: GYAE6OF02FT1SX.26.71.G05.1.454.CMB.1.raw
  modified_base (168)..(168): a, c, t, g, unknown or other
  misc_feature (168)..(168): n is a, c, g, or t
  modified_base (287)..(287): a, c, t, g, unknown or other
  misc_feature (287)..(287): n is a, c, g, or t
  modified_base (453)..(453): a, c, t, g, unknown or other
  misc_feature (453)..(453): n is a, c, g, or t
tcagagactatactcacgaccggtgctcgatttagtgtcgtcgcaagagagaggggggactcctgtgcccaccatggacacgctttgctccacgctcctgctgactgaccatcccttcatgggtcttgtccagatcaccttgagagtctggtcctgcgctggtggacncccacgcagaccctcacgctgacctgcctccgtctctggatttcctcactcaccacgactgaggtacgaatcgtcggctacgggtccgtcgacggaccccggaacgccgtggagtcgtnttgcactctatttcgtggagtcactctcgaagtcgtaacacttcgtctcgtgaggactcgacctcaccataccgaaccgacggtaccaacccgtacgaaacggtccgggttacgttaccttacgaaacgtcgaaccgactatacgtacttccgtagtacggaaccncgaaggtccaacgtattacgttactgtcgtacacgtacacgtactacggcgtacctaggacgaaagaaatagtatacgcgttacggtacgggtaacgtagggttaaccgtttccggtctaacccgggtccctacccggtaacctccgtacccgtacggtaacccgg

SEQ ID NO: 167224 - DNA, 671 bp, Homo sapiens
  misc_feature: GYAE6OF02HE9RQ.26.71.G05.1.454.CMB.1.raw
  modified_base (184)..(184): a, c, t, g, unknown or other
  misc_feature (184)..(184): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (420)..(420): a, c, t, g, unknown or other
  misc_feature (420)..(420): n is a, c, g, or t
tcagagactatactcacgaccggtgctcgatttagtgtcgtcgcaagagagagggggctgggcctcaggaagcagcatcgggaggtgcctcagccatggcatggatccctctcttcctcggcgtccttgcttactgcacgaggactccggtggcccttcgatgagctgattcacgcccaccctnagtcgtcccgtcgtccccaggaccagaccagcccaccatccacctgcctcggacagaactaaaggtgganaatagaangctgcctggtataccgaggacgcacggccacgtcccttagtttggctagttccttacaagataagacgccgacctcgaggtactccgacgtaccgtacttacgtcgacctaccgtaactcgtacggaactacgacgaccctacgtctaccgacctaanccgaacgggtcccggacctacggaccgaaacggtacgacgggaaggacgtaacttaacgttacgttagtccggacgggtcggtaagggaacgtaagttaccgttaagttgggttacggttgggtttacgggaccggggttaacggacgtcgggtacgtaccggaccggttaccgtaaggtaccgacggtacccgacgtaccggtccccgtaccccgttgtcccgtaccgtttacccgcccggtttaccccc

SEQ ID NO: 167225 - DNA, 485 bp, Homo sapiens
  misc_feature: GYAE6OF01DBIQ5.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatatggaaagtgggtccatcaaggttcagcgcagtggatctgggacagaattcactctcaccatcagcagcctacagcctgatgattttgcgtacttattattgacaacagtaataagtagttattcaactttcggaccctgggaccaatgtaggatagtcaaagactgtgctgcacatctgtcttc

SEQ ID NO: 167226 - DNA, 513 bp, Homo sapiens
  misc_feature: GYAE6OF01C8CFG.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtacccatcaaggttcagcggcagtggatctgggacagaattcactctcaccatcagcagcctacagcctgatgattttgcgtactttattattgacctaacagtataaagtagtttattactaactttccggtccctagggacctaagtgtacggtaatagtacaaacgaacttagtggactggcaccattcg

SEQ ID NO: 167227 - DNA, 498 bp, Homo sapiens
  misc_feature: GYAE6OF01B67K6.16.81.H04.1.454.CMB.1.raw
  modified_base (414)..(414): a, c, t, g, unknown or other
  misc_feature (414)..(414): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatatggaaagtggggtccatcaaggttcagcggcagtggatctgggacagaattcactctcaccatcagcagcctacagcctagatgattttgcgtactttattattgaccaanagtaataagtagtttattctaactttcggccctagggacctaagtgtaggatatacaaacgactgtggctgacaccatctgttc

SEQ ID NO: 167228 - DNA, 524 bp, Homo sapiens
  misc_feature: GYAE6OF01BO1ET.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatatggaaagtgggtccatcaaggttcagcggcagtggatcgtgggacagaattcactctcaccatcagcagcctacagcctgatgtattttgacgtactttattattcgaccaaactagtaataagtagtttattactaactttcggacccgtagggaacctaagtgtaggtataacgtacgaaacgtaactggtagtctcggtaccacctattcttgttcttac

SEQ ID NO: 167229 - DNA, 483 bp, Homo sapiens
  misc_feature: GYAE6OF01CQBWR.16.81.H04.1.454.CMB.1.raw
  modified_base (464)..(464): a, c, t, g, unknown or other
  misc_feature (464)..(464): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcggcagtggatctgggacagattcactctcaccatcagcagcctacagcctgatgtatttgcgtacttattattgccaacagtataagattatcaacttcgcctggacctatgtgatatcaacgtaactgtacgntcgacacatctgttcttac

SEQ ID NO: 167230 - DNA, 532 bp, Homo sapiens
  misc_feature: GYAE6OF01CHEBL.16.81.H04.1.454.CMB.1.raw
  modified_base (390)..(390): a, c, t, g, unknown or other
  misc_feature (390)..(390): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgtggtactggttggcctggtatcagcagaaaccagggaaacgccctaagctcctgatctatgatgtctaccaatagtaggaaagtcggggtacccaagtcgaaggttcaaggcggacaggtggatcgtgggactaagaattcactcacaccatcagcacgctacngcctgatgtatttgctacttattatcgacaactagtaataagtagtttaacttctaaactttcggaccctagggaaccctaagttcggtaggataacgtacaaaacgtactggtcgcttacgcaacctatccttgtccttac

SEQ ID NO: 167231 - DNA, 491 bp, Homo sapiens
  misc_feature: GYAE6OF01EAKQJ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtactttattattgaccaacagtataagtagttattactaactttcggaccctgggaccaagtgtaggatatcaaagatgtgctgcacatctgtcttc

SEQ ID NO: 167232 - DNA, 503 bp, Homo sapiens
  misc_feature: GYAE6OF01CI3YT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctcctttccaccctgtctgcatctgtcggagacagagtcaccatcacttgccgggccagtcagagtgttggacctggttggcctggtatcagcagaaaccagggaaagcccctaagctcctgatctatgatgtctccaatatggaaagtggggtcccagtcaaggttcagcggcagtggatcgtgggacagaattcactctcacctatcagcagcctacagcctgacttgattttcgacgtactttattatttgacctaaactagtaattaagagtttattacaacgtttcggcctgggaccaagtgtggatactcaaacgatgtgctgcacatctgtcttc

SEQ ID NO: 167233 - DNA, 560 bp, Homo sapiens
  misc_feature: GYAE6OF01A3PNJ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggttcagcggcagtggatcgtgggacagaattcactctcacatcagcagcctacagcctagatgattttgcgtacttattattgacctaacagttaataagtagttattactaaccgttttcggaccccttagggaaccctaagttggttacgggtaattaacgtaccgtaaaacggtaaccgttggttacgggtacttacggacctaaccctaatttccgttcgttccgtttacccg

SEQ ID NO: 167234 - DNA, 517 bp, Homo sapiens
  misc_feature: GYAE6OF01AR8IO.16.81.H04.1.454.CMB.1.raw
  modified_base (275)..(275): a, c, t, g, unknown or other
  misc_feature (275)..(275): n is a, c, g, or t
  modified_base (513)..(513): a, c, t, g, unknown or other
  misc_feature (513)..(513): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaancccctaagctcctgatctatgatgtctccaatatggaaagtgggtcccatcaaggttcagcggcagtgatcgtgggacagattcactctcaccatcagcagcctacagcctgattgtattttcgacgtacttattattgcctaactagttaataagtagtttaattcgtaactttccggaccctgggacctaagtgtaggtatatacgaaacgtaacgtgttcggactagctaccgtntccg

SEQ ID NO: 167235 - DNA, 494 bp, Homo sapiens
  misc_feature: GYAE6OF01DS61Z.16.81.H04.1.454.CMB.1.raw
  modified_base (491)..(491): a, c, t, g, unknown or other
  misc_feature (491)..(491): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagtagttattctaactttcggccctgggacctaagtgtaggatatcaaacgaatgtggctgcacatctgtcttntac

SEQ ID NO: 167236 - DNA, 495 bp, Homo sapiens
  misc_feature: GYAE6OF01B7H81.16.81.H04.1.454.CMB.1.raw
  modified_base (416)..(416): a, c, t, g, unknown or other
  misc_feature (416)..(416): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctagattgtattttgcgtactttattattgaccaanagtaataagagttattcaactttcggaccctggaccaagtgtgatatcaaagactgtggctgacaccatcctgtcttac

SEQ ID NO: 167237 - DNA, 483 bp, Homo sapiens
  misc_feature: GYAE6OF01AHGVE.16.81.H04.1.454.CMB.1.raw
  modified_base (467)..(467): a, c, t, g, unknown or other
  misc_feature (467)..(467): n is a, c, g, or t
tcagtgtactactccacgaccggtgctcgatttagtagtgtagattcgcggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagagttattcaactttcggccctgggaccaatgtggatagtcaaagactgngctgcacatctgtctc

SEQ ID NO: 167238 - DNA, 499 bp, Homo sapiens
  misc_feature: GYAE6OF01EZCVU.16.81.H04.1.454.CMB.1.raw
tcagtgtactactccacgaccggtgctcgatttagtagtgtagattcgcgggggtcgaggactcagtcaggaccaccagcatggacatggagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggttcagcggcagtggatctgggacagaattcaactctcaccatcagcagcctacagcctgatgattttgcgacttattattgccaacagtataaagagttattacaactttcggcccttgggaccaatgtggatatcaaacgaactgtggactgacaccaatctgtcttac

SEQ ID NO: 167239 - DNA, 565 bp, Homo sapiens
  misc_feature: GYAE6OF01B1HYY.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaagcccctaagctcctgatctatgatgtctaccaatatggaaagtggggtcccaatcaaggttcagcggcagtgatctgggacagaattcactctcaccatcagcagcctacagcctagactgtattttgacgtactttatattcgacaaacgagtaataaagagtttaattacctaaacgttttcggaccccttaggggaaccctaagttacggttaggtaattaacgtacctaaaacggtaaaccgttggtaacgggtccttaggaccctaaccctaagttccttggttacctttacc

SEQ ID NO: 167240 - DNA, 546 bp, Homo sapiens
  misc_feature: GYAE6OF01CP3JU.16.81.H04.1.454.CMB.1.raw
  modified_base (424)..(424): a, c, t, g, unknown or other
  misc_feature (424)..(424): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaacgccctaagctcctgatctatgatgtctaccaatagtaggaaagtcggggtacccagtcaaggttcaggcggcagtggatcgtagggacagaacttcgactctacacatcagcagcctacagcctgatgtattttgcgtacttattattgacctaanacgttaataagtagtttaacttactaacttttccggacccttagggaacctaagtgtaggtaataacgtacaaacgtaacgttggtacggactacgacctaactattcttgttcctttaccg

SEQ ID NO: 167241 - DNA, 574 bp, Homo sapiens
  misc_feature: GYAE6OF01B8VZO.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctctgatctatgatgtctccaatatggaaagtggggtcccagtcaaggttcagcggcagtggatcgtgggacagaattcactctcaccatcagcagcctacagcctgatgattttgacgtactttattattcgacctaaactagtaacttaaagtagtttaatttacctaaccttttccgggaccccttaggggtaacccctaagttacggtaggtaacttaagtaccgtaaaacgtaaacggttggttacggtaccttaggtacctaaccctattcccttaggttcctttaacccg

SEQ ID NO: 167242 - DNA, 485 bp, Homo sapiens
  misc_feature: GYAE6OF01DTAJN.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatatggaaagtggggtcccatcaaggttcagcggcagtgatctgggacagaattcactctcacatcagcagctacagcctgatgattttgcgtacttattattgccaacagtaataagagttattctaactttcgccctggacctaatgtagatagtacaaagactgtaggctgcacatctgtcttc

SEQ ID NO: 167243 - DNA, 548 bp, Homo sapiens
  misc_feature: GYAE6OF01ETNM7.16.81.H04.1.454.CMB.1.raw
  modified_base (365)..(365): a, c, t, g, unknown or other
  misc_feature (365)..(365): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatttgtcggagacagagtcaccatcacttgccgggccagtcagagtgttggtacctggttggcctggtatcagcagaaaccagggaaagcccctaagctcctgatctatgatgctccaatatggaaagtggggtcccagtcaaggttcagcgcagtgatctggacagaattcactctcacctacntacacgacacgcctacgacgtcctgtatgtatttagtactatcttacttacttactaacaacgtaagtaattaagttacgttacttacgttaccgttaccgtaccgtacggtacgtacgtagtagtaagtactaacgtaacgtaacgtacgtacgtacgtacgtacacctacttcgttcgttc

SEQ ID NO: 167244 - DNA, 609 bp, Homo sapiens
  misc_feature: GYAE6OF01EMN1Q.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccattctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtccatcaaggttcagcggcagtggatcgtgggacagaattcactctcaccatcagcacgcctacagcctgatgtattttgacgtacttatttattcgaccaactagtaattaaaggtagtttaactttacctaaaccgttttccgggaccccttagggggtaaccctaaagttcgggttagggtaaacgttaacgttaacccgtaaaaaccggtaaaccgtttacgggttacggggtacccgttaccgggtaacccctaaaccccgttaactttccccgttggttttaaccccc

SEQ ID NO: 167245 - DNA, 517 bp, Homo sapiens
  misc_feature: GYAE6OF01CVY4J.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcaagaaaccagggaaacncccctaagctcctgatctatgatgtctcaatataggaaagtgggtcccatcgaaggttcagcggcagtggatcgtagggacagaattcactctacacatcagcagcctacagcctgactgtattttgacgtatttatattgaccaatagtaataagtattattacaacgtttccgacctagggaccaagtggtagattacacgaaacgtatggtcggctaggacctacctattctcgttcttctacc

SEQ ID NO: 167246 - DNA, 558 bp, Homo sapiens
  misc_feature: GYAE6OF01C36ON.16.81.H04.1.454.CMB.1.raw
  modified_base (332)..(332): a, c, t, g, unknown or other
  misc_feature (332)..(332): n is a, c, g, or t
  modified_base (361)..(361): a, c, t, g, unknown or other
  misc_feature (361)..(361): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggtgcctggtatcagcagaaaccagggaaacgcccctaagcctcctgatctatgatgtctcaatataggaaagtgggtcccatcaagttcagcggnagtgatcgtgggacagattcactctcacntcagcacgcctacacgtcctgactgtattttgaccgttatttattacttcgacctaaactagtaataagtacgtttattaccgtaacgtttccgggacccttaggggaaccctaaagttcggtaggaattacgtaaccgtaaacgtaacgttggtacggtacttcggacctaacctattaccgtgttccctttaccg

SEQ ID NO: 167247 - DNA, 502 bp, Homo sapiens
  misc_feature: GYAE6OF01AV091.16.81.H04.1.454.CMB.1.raw
  modified_base (420)..(420): a, c, t, g, unknown or other
  misc_feature (420)..(420): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggttcagcggcagtggatctgggacagaattcactctcacatcagcagcctacagcctgatgattttgacgtactttattatttgacctaanagtaattaagagtttattctaactttcggcctgggacctaagtgtggatacgtacaaacgtactgtagctagcncgtntccg

SEQ ID NO: 167248 - DNA, 555 bp, Homo sapiens
  misc_feature: GYAE6OF01DMXJV.16.81.H04.1.454.CMB.1.raw
  modified_base (223)..(223): a, c, t, g, unknown or other
  misc_feature (223)..(223): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtgacatccagatgacccagtctccttccacctgtctgcatctgtcggagacagagtcaccatcacgttgccgggccagtcagngtgttggactggttgcctggtatcagcaagaaaccagggaaacgcccctaagctcctgatctatgatgtctacaatataggaagtgggtccagtcaaggttcagcggcagtgatcgtgggacagaattcaactctcaccatcagcacgacctacacgtcctagacttgtattttgacgttactttattacttacgactaaacgtagttaataagtagtttacttacgtaaccgttttcgggacccttagggaaccctaagttcgtaggtaataacgtacaaacggtaacttggtacggtctacgtaccaaccctatccgttagtctttaccg

SEQ ID NO: 167249 - DNA, 489 bp, Homo sapiens
  misc_feature: GYAE6OF01CPSGX.16.81.H04.1.454.CMB.1.raw
  modified_base (409)..(409): a, c, t, g, unknown or other
  misc_feature (409)..(409): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgtggtactggtggcctggtatcagcagaaaccagggaaagcccctaagctcctgatctatgatgtctccaatatggaaagtggggtccatcaaggttcagcggcagtggatcgtgggacagattcactctcacatcagcacgcctacagcctgatgtattttgctacttattattgaccaanagttaataagtagttattctaactttcggcctaggaccaatgaggtatatactaagactgtagctgcacatctgtcttac

SEQ ID NO: 167250 - DNA, 496 bp, Homo sapiens
  misc_feature: GYAE6OF01AIFJG.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccaggggaaagcccctaagctcctgatctatgatgtctccaatatggaaagtggggtcccatcaaggttcagcggcagtggatctgggacagaattcactctcaccatcagcagcctacagcctgatgattttgcgtacttattattgaccaacagttataagtagttattactaactttcggccctgggacctaatgtaggatatcaaagactgtggtctgccacatctgtcttac

SEQ ID NO: 167251 - DNA, 519 bp, Homo sapiens
  misc_feature: GYAE6OF01EBJND.16.81.H04.1.454.CMB.1.raw
tcagtgtactactccacgaccggtgctcgatttagtagtgtagattcgcgggggtcgagactcagtcaggacacagcatggacatgagggtccccgctcagctcctggggctcctgcctgctctggctcccaggtatcaaatgtgacatccagatgacccagtctccttccaccctgtctgcatctgtcggagacagagtcaccatcacttgccgggccagtcagagtgttggtacctggttgcctggtatcagcaagaaaccagggaaagcccctaaagcctcctgatctatgatgtctcaatatggaaagtggggtcccatcaaggttcagcggcagtgatcgtgggacagaattcactctcacatcagcagcctacagcctgatgattttgcgtactttattattgaccaactagtataagtagtttattctaactttcggcctagggtaccaagtggtagagttactacgaaacgtaactggtcggactggaccacctattaccgtgttcttacc

SEQ ID NO: 167252 - DNA, 533 bp, Homo sapiens
  misc_feature: GYAE6OF01DNK72.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagccctaagctcctgatctatgatgtctccaatatggaaagtgggtccatcaagttcagtggcagtgatctgggacagaattcactctcaccatcagcagcctacacgcctgatgattttgcgtacttattattgacctaactagtataagtagtttaattacgtaacttttcgggacccttaggggaccctaaagtcgttagggattacgtacgtaaaacgtaacttggtcggcttagacctacctatcttacgttccttctacc

SEQ ID NO: 167253 - DNA, 559 bp, Homo sapiens
  misc_feature: GYAE6OF01D52KO.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaaccagggaaagcccctaaagctcctgatctatgatgtctccaatatggaaagtggggtcccatcaaggttcagcggcagtggatctgggacagaattcactctcaccatcagcagcctacagcctgatgtattttgcgtactttattatttgacctaaacagtaataaagtagtttaatttactaaacgttttccggaccccttaggggaaccctaaagttggttaggaacttaagttaccgaaaacgtaaacgttggtacggtctacggacctaacccaattccttgttcctttacccg

SEQ ID NO: 167254 - DNA, 596 bp, Homo sapiens
  misc_feature: GYAE6OF01CVD95.16.81.H04.1.454.CMB.1.raw
  modified_base (388)..(388): a, c, t, g, unknown or other
  misc_feature (388)..(388): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctccaggtatcaaatgtgacatccagatgacccagtctccttccaccctgtctgcatctgtcgagacagagtcacatcacttgccggcagtcagagtgttggacctggttggcctggtatcagcagaaaccaggaaacgccctaagctcctgatctatgatgtctccaatagtggaaagtcgggtaccatcaaggttcagcgcagtgatcgtggacagaattcactctacacgatcagcacgacctacacgcctagagtacgtnttttcgacgtaacttattacttggaacctaactaagttaacttaaaggtacgtttaatttccgtaaacgttttccggtacccgttacggggtaccctaaaggttcggtagggtaacttaacgttaaccgtaaaaacgtaacgttacgggttacggtaccgttacggacctacccggtaattccgtttacggttcctttccgttaaccc

SEQ ID NO: 167255 - DNA, 532 bp, Homo sapiens
  misc_feature: GYAE6OF01DOPCZ.16.81.H04.1.454.CMB.1.raw
  modified_base (380)..(380): a, c, t, g, unknown or other
  misc_feature (380)..(380): n is a, c, g, or t
tcagtgtactactccacgaccggtgctcgatttagtagtgtagattcgcgggggtcagactcagtcaggacacagacatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcagaaaccagggaaagcccctaagctcctgatctatgatgtctccaatatggaaagtgggtcccatcaaggttcaggcggcagtggatctgggacagaattcactctcaccatcagcacgcctacancctgatgtattttgcgtactttattatttcgacctaactagtaataagtaatttattactaacgttttcggacccttgggaacctaagtgtagtattaacgtacgaaacgtaacgtggtaggcttacgcctaacctattccttgtcttaccg

SEQ ID NO: 167256 - DNA, 598 bp, Homo sapiens
  misc_feature: GYAE6OF01C61S1.16.81.H04.1.454.CMB.1.raw
  modified_base (387)..(387): a, c, t, g, unknown or other
  misc_feature (387)..(387): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcaattgccgggcagtcagagtgtggtacctggttggcctggtatcagcagaaaccagggaaagccctaagctcctgatctatgatgtctctaatataggaaagtcggggtcccagtacgaaggttcaggcggacaggtggatcgtgggacagaacttcactctacaccatcagcaacgcctanacgtcctagattgtattttgacgttaactttatttattacgacctaaacgtagttaaacttaaaggttagttttaactttaccgtaaaccgttttccgggacccgttacggggtaaccctaaaggttcggtagggtaacttaacgtaacgaaaacggttaacgttggtacggtacttcggacctaacctagttccttggttccctttaccg

SEQ ID NO: 167257 - DNA, 529 bp, Homo sapiens
  misc_feature: GYAE6OF01B4JON.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggttcagcggcagtggatcgtgggacagattcactctcacatcagcagcctacagcctgatgtattttgcgtactttattattcgacctaacgtagtaataagtagtttaattaccgtaacgttttccggacccttaggggaacctaagtgtaggtattagtacgtaaacgaacgttggtacggctacgccacctatctgttcttac

SEQ ID NO: 167258 - DNA, 570 bp, Homo sapiens
  misc_feature: GYAE6OF01B23IQ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcaagaaaccgagggaaacgcccctaagctcctgatctatgatgtctaccaatagtaggaaagtgggtcccagtcaaggttcagcggcagtgatcgtgggacagtattcactctacaccatcagcacgtcctacacgtcctagtatgtattttgaccgttaactttatttacttacgacctaaacgtagttaaattaagttaagtttacttaccgttaaccgttttccgggacccgttagggtaaccctaaggttcgtaggtaattaacgtacgaaaacgtacgtggtagtctacgtactacctattccttgtccttac

SEQ ID NO: 167259 - DNA, 576 bp, Homo sapiens
  misc_feature: GYAE6OF01EAC0P.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaacgcccctaagctcctgatctatgatgtctccaatagtaggaaagtgggtcccagtcaaggttcagcggcagtggatcgtgggacagtaattcgactctacacatcagcacgcctacacgtcctagatgtattttgacgttactttattacgttcgacctaataagttaataaagtagtttaattaccgtaaacgttttccggacccgttagggaaccctaagttcggtaggtaaattaacgtaccgtaaaacgtacgttcggtacggtacctacggtacctaaccgtagttcttcggttcctttacccg

SEQ ID NO: 167260 - DNA, 497 bp, Homo sapiens
  misc_feature: GYAE6OF01CP290.16.81.H04.1.454.CMB.1.raw
  modified_base (321)..(321): a, c, t, g, unknown or other
  misc_feature (321)..(321): n is a, c, g, or t
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgtgactggtgctggtatcagcagaaccaggaagccctaagctcctgatctatgatgtctacaatatggaaagtgggtccatcaaggttcagcgcagnggatctggganagtaatcgactctacacatcagcagcctanagcctgactgattttgacgtacttattatgacaactagtaataagtattaacttataaactttcggaccctggtaaccaagtgtaggattaagctaaagactgtaggactggtcaacctagttacctgtccttac

SEQ ID NO: 167261 - DNA, 566 bp, Homo sapiens
  misc_feature: GYAE6OF01EUEMW.16.81.H04.1.454.CMB.1.raw
  modified_base (329)..(329): a, c, t, g, unknown or other
  misc_feature (329)..(329): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccaggaaagcccctaagctcctgatctatgatgtctcaatatggaaagtgggtccatcaaggttcagcgnagtgatcgtggacagtatcactctcacatcacgcacgcctacgacgtcctagtagttcgttattttcgacgttaacttttattacgttcgaacctaaataaggttaattaaaggtacgtttaacttaccgttaaaccgttttccgggacccgttagggtaacctaaggttcggtaggtaacttacgtaacgaaacgtaacttggtacgtctacgacctacctattctcgttcttacg

SEQ ID NO: 167262 - DNA, 502 bp, Homo sapiens
  misc_feature: GYAE6OF01DW19P.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgtattttgcgtactttattattgcctaaacagttaataagtagtttattctaactttcggaccctggaccaagtgtggatagtacaaagactgtcggctgacaccattctgtcttac

SEQ ID NO: 167263 - DNA, 605 bp, Homo sapiens
  misc_feature: GYAE6OF01BH0X7.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaccagggaaacncccctaagctcctgatctatgatgtctccaatagtaggaaaggtcggggtacccagtacgaaggttcaggcggacaggtggatcgtggacagaacttcactcacacatcagcagcctacacgcctagactgtattttcgacgttactttattacgttacgaaccctaacgtaagttaattaaacggtagttttaactttaccgttaaaccgttttccgggacccgttagggtaacccgtaagttcggtaaggtaacgttaacgttaaccgtaaaaccggtacgttaggttacggaccgttcgaccctaaccgttacttcccgttacggtttaccc

SEQ ID NO: 167264 - DNA, 563 bp, Homo sapiens
  misc_feature: GYAE6OF01BIUG0.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctacaatatggaaagtgggtcccatcaaggttcagcggcagtggatcgtgggacagaatcactctcaccatcagcagcctacagcctgatgtattttgcgtactttattattcgacctaactagttaataagtagtttaattacttaaaccgtttccgggacccttagggaaccctaaagttcggtaggtaacttaagtaccgtaaaacggtaacttgggtacggtactacggacctaacccgtaattccttcggtttcctttacccg

SEQ ID NO: 167265 - DNA, 487 bp, Homo sapiens
  misc_feature: GYAE6OF01DKYTN.16.81.H04.1.454.CMB.1.raw
  modified_base (367)..(367): a, c, t, g, unknown or other
  misc_feature (367)..(367): n is a, c, g, or t
  modified_base (414)..(414): a, c, t, g, unknown or other
  misc_feature (414)..(414): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgcccctaagctcctgatctatgatgtctcaatagtaggaaagtggggtcccatcaaggttcagcggcagtggatcgtgggacagattcactctcacntcagcagcctacagcctagatgtatttgcgtattattattgaccaanagtaataagtattattctaactttcggcctggactaagtgtgatatacaagactgngntgacacatctgtntc

SEQ ID NO: 167266 - DNA, 512 bp, Homo sapiens
  misc_feature: GYAE6OF01CF0RS.16.81.H04.1.454.CMB.1.raw
  modified_base (374)..(374): a, c, t, g, unknown or other
  misc_feature (374)..(374): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatatggaaagtgggtccatcaaggttcagcggcagtggatcgtggacagaatcactctcacatcagcagcctanagcctgactgtatttgacgtactttattattgacctaacagtaataagtagtttattactaacgttttcggaccctagggaacctaagtcggtaggatactacaaacgtacttggtggactgacacctatctgttacc

SEQ ID NO: 167267 - DNA, 753 bp, Homo sapiens
  misc_feature: GYAE6OF01DCABB.16.81.H04.1.454.CMB.1.raw
tcagtgtactactccacgaccggtgctcgatttagtagtgtagattcgcgggggtcagactcagtcaggacacagcatggacatgagggtccccgctcagctcctgggggctccccgctgctcctggcgtcccacggtagtcaatagtgacatccagatcgacccacgtctccttccctaccctcgtctcgcattctgtcggagacagagtccaccactcacgttcgccgggccagtcgagagttgttgggttaccgttcgggttggtcctggttaatccaggacgaacgaaaccgagggaaacgcccctaagctcctgtatctatgtactcgttcctactaaacgtggtacgtaagggtccgggtacctactagtaacgggtcgacggacggtcgtaggtggtacgtcggtacggaacgtaaatacgttttcccacgtacctaccaacctatccgacgcgtacccgactacgtactgtacgtagttagtttacgtttcgtaccgttaattttcgttaagttccgaaaccgttaacgtaatttaaggttaaacgttaacgttttttaaccgtacccgtttaaacccgggttttccccgggtacccgggaaccggttaaacgttaaacgtttgggtaccggttaaattaaacccgttaaccggaaaacggttacggtttcggtacccgggccgttaacggacccccttaacttaacggttttccgtttaccgttaacctttccccgtaaccccg

SEQ ID NO: 167268 - DNA, 583 bp, Homo sapiens
  misc_feature: GYAE6OF01ECQZJ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcactgccggccagtcagagtgttggtacctggttgcctggtatcagcaagaaaccaggaacgcccctaagctcctgactcgtatgatgtctaccaatagtaggaaacggtcgggtacccaagtcgtaaggttcaaggcggcaggtggatcgtagggacagtaacttcactctcacgatacacgcacgtcctaacgcgtacctagactgttacttttcgacgttaactttacttagttcgactaagtaagtaagtaagtatttacgttacgttaaccgttccggtacccgtacgggtaacctaagttcgtagtaacttaagtaaccgtaaagtaccgttgtacggtactacgtaccaccgtattcgttcgttcgttaccg

SEQ ID NO: 167269 - DNA, 533 bp, Homo sapiens
  misc_feature: GYAE6OF01DS243.16.81.H04.1.454.CMB.1.raw
  modified_base (387)..(387): a, c, t, g, unknown or other
  misc_feature (387)..(387): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgcccctaagctcctgatctatgatgtctacaatatggaaagtgggtacccatacgaaggttcaggcggacagtggatcgtgggacagaattcactctcaccatcagcacgcctaacngcctgatgtatttgacttacttattattcgactaatagttaataagtagtttaattacgtaaccgttttccggacccgttagggaacctaagtcggtagtataacgtacaaacgtactggtagtctacgtcactatcttgtcttac

SEQ ID NO: 167270 - DNA, 740 bp, Homo sapiens
  misc_feature: GYAE6OF01DFZME.16.81.H04.1.454.CMB.1.raw
  modified_base (224)..(224): a, c, t, g, unknown or other
  misc_feature (224)..(224): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcacatcacttgccgggcagtcagngtgttggtacctggttgcctggtatcagacaagaaaccgagggaacgtacccctaagctcctgatctatgatgtctacaatagtaggaaaggtcgggtacccagtacgtaagggttcaaggcggacgtagggtaggtatacggtaggggaactaagggtaaatttcccgaaccttactacccgaaccctaagttaccaacggtaccaaccggtacccttaacgacgtcccgtagtaacgttaggttacgtttttacggaacccgtttaattttaactttaacgtttacgtaaacccgtaaacgttaaaggtttaaacgttaaaggtttaacgtttttaaacgttttaacccttaaacccggttttcccggggtaaccccgttacggggaaacccttaaggttacggtacgggtaaattaaacgttaaaccgtaaaacggtaaccgtttgggtaccgggttacccttacggaacccgttaaccgttaacgtttcgtttaacgttcccgtttaacccg

SEQ ID NO: 167271 - DNA, 697 bp, Homo sapiens
  misc_feature: GYAE6OF01BIY27.16.81.H04.1.454.CMB.1.raw
  modified_base (192)..(192): a, c, t, g, unknown or other
  misc_feature (192)..(192): n is a, c, g, or t
  modified_base (282)..(282): a, c, t, g, unknown or other
  misc_feature (282)..(282): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcgganacagagtcaccatcacgttcgccgggccagtcagtagttggttcggtacctgggttcggcctggtatcgagcaagaaaccgagggaaacncccctaagcctcctgatctatgatcgtctacctaatacgtaggaaacggtcgggtacccagtacgtaaggttcgacggtcggcgtaggtcggattccgtagggaactaacggtaacttccacgttcctacaccgtatccgacgcaccggtaccctacgtacgccgttagtacgtttaggttacttttcggaaccgtttaacttttaacgtttacgttacggaaccctaaacgttaaggttaacgttaaaacggtttacgttttaacctttaaccccgttaaaccggtttttcccgggaaccccggttaagggtaaccctaagttcggtaacggtaattaaaccgtacgtaaaaccggtacgttcggtacggtccttacggtaccctaaccttatttccgttcgttcctttacccg

SEQ ID NO: 167272 - DNA, 526 bp, Homo sapiens
  misc_feature: GYAE6OF01BU0Y5.16.81.H04.1.454.CMB.1.raw
  modified_base (374)..(374): a, c, t, g, unknown or other
  misc_feature (374)..(374): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagatcaccatcacttgccgggccagtcagagtgttggtacctggttggcctggtatcagcagaaaccagggaaagcccctaagctcctgatctatgatgtctcaatatggaaagtgggtcccatcaaggttcagcggcagtggatcgtgggacagattcactctacacatcagcagcctancgcctgatgtatttgacgtactttattattgaccaactagtaataagtagttaacttacaacgttttcggaccctagggtaacctaagtcgtaggtaatacgtacgaaacgtagtgtacggtctacgtaccacctattcctagttcttaccg

SEQ ID NO: 167273 - DNA, 580 bp, Homo sapiens
  misc_feature: GYAE6OF01A30FD.16.81.H04.1.454.CMB.1.raw
  modified_base (270)..(270): a, c, t, g, unknown or other
  misc_feature (270)..(270): n is a, c, g, or t
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
tcagtgtactactccacgaccggtgctcgatttagtagtgtagattcgcgggggtcgaggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaancccctaagctcctgatctatgatgtctccaatatggaaagtgggtcccatcaagttcagctgcagtgatcgtgggacagtaattcactctcaccntcagcagcctacagtcctaggatgtattttgngtactttattactttgacctaactagtaattaaggtatttaatttaccctaaagttttcccgggacccttacggggaaccctaaagtttcggtaaggtaatttaacgtaacccgtaaaacggtaaaccgttggtacgggtacctttacggacccctaaccgtaacgtttcttcggtttaaccc

SEQ ID NO: 167274 - DNA, 530 bp, Homo sapiens
  misc_feature: GYAE6OF01C7ROI.16.81.H04.1.454.CMB.1.raw
tcagtgtactactccacgaccggtgctcgatttagtagtgtagattcgcgggggtcagactcagtcaggacacagcatggacatgagggtccccactcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatataggaaagtcggggtcccagtcaaggttcaggcggcagtggatcgtgggacagtattcactctcacatcagcagcctacagcctagatgtattttgcgtacttattactttgacctaacagttaataagtagtttattactaacgttttccggacccttggggaaccctaagttgtaggtatagtacgaaacgtactggtaggctagccaacctatcctgttcttacc

SEQ ID NO: 167275 - DNA, 494 bp, Homo sapiens
  misc_feature: GYAE6OF01ETPOF.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcacatcagcagcctacagccctgatgattttgcgtacttattattgaccaacagtataagagtttattctaactttcggccctagggaccaagtgtaggatagtcaaacgactgtagctgcacatctgtcttac

SEQ ID NO: 167276 - DNA, 627 bp, Homo sapiens
  misc_feature: GYAE6OF01DQMBP.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgcccctaagcctcctgatctatgatgtctaccaatagtagggaaaggttcggggtaccccagttaccgtaagggttccaaggcggactaggtggattcgtaggggaactaagtaactttccgaacttccgtacacctatcgaacgccacgacctaacacgtacctagtacgttgttagttttcgacgttaacttttagtttacgttcgaacctaaacgtaagttaagtaaacgttagtttaactttccgtaaaccgttttccgggaccccgttaggggaacctaagttcggtagtaattaacgtacgaaaacgtacttggtcggtacttcggacctaccgtattccttgttccttac

SEQ ID NO: 167277 - DNA, 584 bp, Homo sapiens
  misc_feature: GYAE6OF01AIEX9.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccgagggaaacgcccctaagcctcctgatctatgatgtcctaccaattagtagggtaaaggtcggggtaccccagttaccgaagggtttccgaggcgggcgtagggtcggtaatcggtaggggaacaaggtaacttcaacctctaccaaccatccagcacgcctacacgcctagattgtattttgacgttactttatttacttcgacctaactagttaattaagttagtttaacttacctaaccgtttcggacccgttaggaacctagtgtagtatacgtacgaaacgtacgtggtacgctacgactaccattctgttcttaccg

SEQ ID NO: 167278 - DNA, 620 bp, Homo sapiens
  misc_feature: GYAE6OF01A7UBQ.16.81.H04.1.454.CMB.1.raw
  modified_base (270)..(270): a, c, t, g, unknown or other
  misc_feature (270)..(270): n is a, c, g, or t
  modified_base (382)..(382): a, c, t, g, unknown or other
  misc_feature (382)..(382): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacncccctaagctcctgatctatgatgtctcaatataggaaagtgggtcccatcaaggttcaggcggcaggtggatcgtgggacaggaattcactctcaccatcagcacgcctanacgccctgattgtagtttttcggacgttaactttattattcgaccctaaataagttaattaaaggttaagttttaacttaccgttaaaccgttttcccgggacccgttacggggtaaccctaagttcgggttacggtaaacttaacgttaaccgaaaaccggtacgttacgggtagggtacccgttaggacccctaaacccgttagttaccctttacggttcctttacccgtaacccg

SEQ ID NO: 167279 - DNA, 580 bp, Homo sapiens
  misc_feature: GYAE6OF01C9YZ6.16.81.H04.1.454.CMB.1.raw
  modified_base (366)..(366): a, c, t, g, unknown or other
  misc_feature (366)..(366): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccggccagtcagagtgttggtacctggttggcctggtatcagcagaaaccaggaaacgccctaagctcctgatctatgatgtctaccaatataggtaaagtgggtcccatcgaaggttcagcggcagtggatcgtgggacagattcactctcacngtcagcagcctacagcctagatgtattttgacgttacttatttattcgacctaacgtagtaataagtacgttttaattaccgtaaccgttttccggacccgttaggggaacccctaaagttacggtacggtaacttaaacgtaaccgtaaaacggtaaccgtttggtacgggtcttacgtaccctaacctatttccgtcgtttcctttaacccg

SEQ ID NO: 167280 - DNA, 624 bp, Homo sapiens
  misc_feature: GYAE6OF01DPVK7.16.81.H04.1.454.CMB.1.raw
  modified_base (271)..(271): a, c, t, g, unknown or other
  misc_feature (271)..(271): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaaatgtgacatccagatgacccagtctccttccaccctgtctgcatctgtcggagacagagtcaccatcacttgccgggccagtcagagtcgttggtacctggttggcctggtatcagcagaaaccagggaacnccccgtaagctcctgatctatgatgtctcaatataggaaagtgggtccatcaagttcagcggcagtggatcgtgggacagattcactctacaccatcagcacgcctacacgcctagactgtattttgcgttactttattactttacgaccctaaacgtaagttaaattaagttaacggttttaactttaccgttaaacccgtttttccgggacccccgttacggggtaaaccccttaaagttcgggtacgggtaactttaaacgtaacccgtaaaaaccggtaacgtttagggtaccgggtccgttacggtaccctaacccgtatttaaccgttcggtttcccttttaacccg

SEQ ID NO: 167281 - DNA, 820 bp, Homo sapiens
  misc_feature: GYAE6OF01BC6YA.16.81.H04.1.454.CMB.1.raw
  modified_base (267)..(267): a, c, t, g, unknown or other
  misc_feature (267)..(267): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgtggtacctggttggcctggtatcagcagaaaccaggaacnccctaagcctcctgatctagtgtatgtctactaatagtagggaaacggttcgggtacccctaagttaccgtaaacggggtttacgaagggtccggacgtaaggtacgggacgttcggtaggggaactaaaggtaactttaccgtaaccttccgtacctaacctacgttaccgacgaccgtaaccggtacccttaaccgacggtaccccgttaagtaacgttacggtttaagttttaccgggtaccgttttaaactttttaacgttttaacgttacgtaaaccccgttaaacgtaacggttttaaagttaaacggtttaaacgtttttaaccgttaacccggttttaaaccccggtttttacccggggacccccgggtttaaagggtaaaccccgttaaaaggttttcggggttaaaccgggttaaacgtttaaacccggttaaaaccccgtaaaaaccggggttaaacccgtttagggttaacccggggaacgtttacccgggaccctttaaaaccccgtaacggttttccccgtttaaccgttttaaccccg

SEQ ID NO: 167282 - DNA, 504 bp, Homo sapiens
  misc_feature: GYAE6OF01ATWNJ.16.81.H04.1.454.CMB.1.raw
  modified_base (335)..(335): a, c, t, g, unknown or other
  misc_feature (335)..(335): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatagtggaaagtgggtccatcaaggttcagcggnagtgatcgtggacagaattcactctcaccatcagcagccctacacgctgatgtatttgctattattatnacctaanagtaataagtattattctaacgttccggacctagggacctatgtcgtatactanaaacgtancggtaggctacgaccaacctatcgtgttacc

SEQ ID NO: 167283 - DNA, 582 bp, Homo sapiens
  misc_feature: GYAE6OF01EHMOY.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcagaaaccaggggaaacncccctaagctcctgatctatgatgtctaccaatagtagggaaaggttcggggtacccatacgtaacggttcaggcggactagggtggactcggtacgggaacaagttaactactactctaccactactcgacgacacgaccctaacacgtccgtagtctagtttagtttcggacgttactttatttatcgaaccaagtattaagtaagttaagtttacttacttaaccgtttcccgaccggtaggaacctagttggtagtaatacgtaacgaaacgtagtggtacgtctcgaccactacttctgttcttacc

SEQ ID NO: 167284 - DNA, 519 bp, Homo sapiens
  misc_feature: GYAE6OF01AZZDW.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatcgtgggacggaattcactctcaccatcagcagcctacagcctgactgtattttgacgtactttattatgaccaatagtaataagtagtttacttcctaaacgttttcggccctagggaccctaagtcgtggaactagtaccaaagtactggtcggctagacacctatctgtcttac

SEQ ID NO: 167285 - DNA, 506 bp, Homo sapiens
  misc_feature: GYAE6OF01E35ZZ.16.81.H04.1.454.CMB.1.raw
  modified_base (416)..(416): a, c, t, g, unknown or other
  misc_feature (416)..(416): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccaggggaaagcccctaagctcctgatctatgatgtctccaatatggaaagtggggtcccatcaaggttcagcggcagtggatcgtgggacagaattcactctcaccatcagcagcctacagcctgattgattttgcgtacttattattcgaccaanagtataaggagtttattactaactttcggcccttagggaccctaagttgtaggaatagtacaaacgaactgtgctgcacatctgtcttac

SEQ ID NO: 167286 - DNA, 528 bp, Homo sapiens
  misc_feature: GYAE6OF01C07FR.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctcaatataggaaagtgggtcccatcaaggttcagcggcaggtgatcgtgggacagacttcactctcacatcagcagcctacagtcctgatgtattttgacgtacttattattgacctaactagttaataagtagtttattctaacgtttcgacccgttgggaacctaagttgtaggtaatagtaacgaaacgtaacttggtaggtctcgacctaacctattcttgttcttac

SEQ ID NO: 167287 - DNA, 511 bp, Homo sapiens
  misc_feature: GYAE6OF01EU9JV.16.81.H04.1.454.CMB.1.raw
  modified_base (380)..(380): a, c, t, g, unknown or other
  misc_feature (380)..(380): n is a, c, g, or t
  modified_base (490)..(490): a, c, t, g, unknown or other
  misc_feature (490)..(490): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggcctggtatcagcagaaaccagggaaagcccctaagctcctgatctatgatgtctcaatatggaaagtgggtacccatcaaggttcaggcggcagtggatcgtgggacagtaattcactctcaccatcagcagcctanagcctagattgtattttgactactttattattcgaccaatagtaataagtagtttattactaacgtttcgccctagggaacctaagtgtaggtatagtacaaagtactgngcttcgcacattctgtcttac

SEQ ID NO: 167288 - DNA, 578 bp, Homo sapiens
  misc_feature: GYAE6OF01CNMUW.16.81.H04.1.454.CMB.1.raw
  modified_base (191)..(191): a, c, t, g, unknown or other
  misc_feature (191)..(191): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccggccagtcagagtgttggtactggttggcctggtatcagcagaaaccagggaacgccctaagctcctgatctatgatgtctcaatagtggaaaggtcgggtacccagtcgaaggttcaggcggcaggtgatcgtgggacagaacttcgactcgtcacctatcagcacgtcctacagcctgaatgtaattttcggcgtacttatttagtcgtacaacgtagttaataagtagtttaattcgtaaaccttttcgggacccgttagggaaccctaagttcggtacggtaattaagtaacccgaaaacggtaacgttcgggtacggtaccttacggtaccctaacctagttcccgttgtttcctttaccg

SEQ ID NO: 167289 - DNA, 571 bp, Homo sapiens
  misc_feature: GYAE6OF01EARXM.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctccaatagtaggaaagtgggtcccatcaaggttcagcggcagtggatcgtgggacagtaatcactctcacatcagcagcctacacgcctagattgtattttgacgtactttattacttcgacctaactagtaataagtagtttaacttactaaccgttttccgggacccttaggggaaccctaaggttacggtaggtaacttaacgtaacgtaaaaccgtaacgttcggtacggtcctacggtacctaaccctagttccgttcgttcctttaccg

SEQ ID NO: 167290 - DNA, 685 bp, Homo sapiens
  misc_feature: GYAE6OF01ELQZ1.16.81.H04.1.454.CMB.1.raw
  modified_base (265)..(265): a, c, t, g, unknown or other
  misc_feature (265)..(265): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggatcagcagaaccaggaacncccctaagctcctgatctatgatgtctacaatagtggaaaggtcgggtaccctagtacgtaacggttcgaacggcggacgtaggtggacttcggtaggactaagtaacttccactactccaaccactaccgaacggtccaaggtccccttaacgacgtccgttagtaacttgtttaacgttttcgaccggtttaaactttacgtttaacgtacggtaaccctaaacgttaagttaaacgttaaggttaacgttttaccgttaacccgttaacccggttttcccgggtaaccccgttaacggggtaaaccctaaggtttacggtaacggtaaacgttaaaccgtaaaccggtaaacgtaaccgttgggttaccgtaccgttacgtacccttaacctatttccgttcgttccgtttaacccc

SEQ ID NO: 167291 - DNA, 625 bp, Homo sapiens
  misc_feature: GYAE6OF01BI5C9.16.81.H04.1.454.CMB.1.raw
  modified_base (422)..(422): a, c, t, g, unknown or other
  misc_feature (422)..(422): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctggtcggagacagagtcaccatcacttggccgggccagtcagagtgttggtacctggttggcctggtatcagcaagaaaccgagggaaacgcccctaagcctcctgactcgtatgatgtctacctaaatagtagggaaaggttcggggtacccagtacgtaaggttcaaggcggacgtaggtggactcgtagggaactaggtaacttcgactctacaccatccgagcgactcccgtaanacgcctagacgttagtattttacggacgttaactttatttactacggtaacctaacgtaagttaagttaaaggttatttaacttaccgttaaaccgttttcgggaaccccgttggaaacctagttcgtaggtaacttacgtaaccgtaaacgtacttgggacgtactacgtacccgtaacctaagtttcctcgtttcttaccc

SEQ ID NO: 167292 - DNA, 520 bp, Homo sapiens
  misc_feature: GYAE6OF01B5NR1.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcaattgccgggccagtcagagtgttggtacctggttggcctggtatcagcaagaaaccagggaaacgcccctaagctcctgatctatgatgtctaccaatataggaagtgggtcccatcaaggttcagcggcagtggatcgtgggacagattcgactctcaccatcagcacgcctacacgcctagattgtattttgacgtactttattatcgacctaactagtaataagtagtttattactaaacgtttcggacccgtagggacctaagtagtgtaatacgtacaaacgactggtgctgacactatctgtcttacg

SEQ ID NO: 167293 - DNA, 544 bp, Homo sapiens
  misc_feature: GYAE6OF01BOBE0.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggttcagcggcagtggatcgtgggacagattcactctcaccatcagcagcctacagcctgattgtattttgcgtactttattattgacctaacagtaagttaagtagtttaattacctaaccgtttccggacccgttagggtaaccctaagttcggtaggtaattaactaccgaaaacgtaacttcggtaggccttaggaccctacccgtattccg

SEQ ID NO: 167294 - DNA, 527 bp, Homo sapiens
  misc_feature: GYAE6OF01E2BEQ.16.81.H04.1.454.CMB.1.raw
  modified_base (517)..(517): a, c, t, g, unknown or other
  misc_feature (517)..(517): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcagaaaccagggaaagcccctaagctcctgatctatgatgtctccaatataggaaagtcgggtcccatcgaaggttcagcggcagtggatcgtggacagtatcactctcaccatcacgcagcctacacgcctgatgtattttcgacgtactttattacttcgacctaagtagttaataagtagtttaattaccgtaacgtttccggacccttagggacctaagtcgtagattactacaaacgtacgtgtggactcgacacctntccgtgttcc

SEQ ID NO: 167295 - DNA, 579 bp, Homo sapiens
  misc_feature: GYAE6OF01B0NHU.16.81.H04.1.454.CMB.1.raw
  modified_base (270)..(270): a, c, t, g, unknown or other
  misc_feature (270)..(270): n is a, c, g, or t
  modified_base (393)..(393): a, c, t, g, unknown or other
  misc_feature (393)..(393): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccggcagtcagagtgttggtactggttggcctggtatcagacaagaaaaccgagggaaacnccccgtaagctcctgatctatgatcgtctacaatataggaaagtcgggtaccagtacgtaaggttcaggcggcaggtgatcgtgggaactagaattcactctacacatcagaccagcctaacncgtacctgacttgtattttcgacgtaatttagttacttcgaacctaaactagttaagtaagttagtttataccgtaacgtttccggaccgtagggtaacctaagtcggtaaggaattaacgtacgtaaaacggacgttcggtacgggtccttaggacctaaccgtaattccttagttcctttaacc

SEQ ID NO: 167296 - DNA, 548 bp, Homo sapiens
  misc_feature: GYAE6OF01BZGHA.16.81.H04.1.454.CMB.1.raw
  modified_base (544)..(544): a, c, t, g, unknown or other
  misc_feature (544)..(544): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaacgcccctaagctcctgatctatgatgtactccaatagtggaaagtgggtacccatcaaggttcagcggcagtggatcgtagggactagaattcgactctcacatcagcacgcctacagcctagtatagtattttgacgttacttattacttgtacccaagtagttaataagtacgtttaacttacgttaaccgtttccggacccgtacggtaacctaagtcggtaggtaatactaacgaaacgtaacgtggttggaccttagaccaccattcgtnttac

SEQ ID NO: 167297 - DNA, 609 bp, Homo sapiens
  misc_feature: GYAE6OF01DJOGT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttcggtactggttggcctggtatcagcagaaaccagggaacgcccctaagcctctgatctatgatgtctacaatagtaggaaagtcggggtacccagtacgtaagggttcgaaggccggacgtaggtggtattcggtgggaacctagtaacttcacttctacacctatacacgcacgcctacacgcctagattgtattttcgacgttaactttatttacgttcgacctaaacgtagttaataaaggtagtttactttacgtaaccgtttccggtacccgttaggggaaccctagttcggtagtaataacgttaccgaaaacgttaacggttgtacgggtaccttacggaccctaaccgtatttccgttcgttcctttaacccg

SEQ ID NO: 167298 - DNA, 562 bp, Homo sapiens
  misc_feature: GYAE6OF01EX4D4.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggcccgggccagtcagagtgttggtacctggttggcctggtatcagcagaaaccagggaaacgcccctaagctcctgatctatgatgtctccaatagtaggaaagtggggtacccatcgaaggttcaggcggacaggtggagtcgtagggacaggtaacttcgactctccacctatacacgaccagcctacacgtcctgatgtattttgacgttactttattattcgacctaacagttaataaagtatttaacttactaaccgttttccgacccgttagggaaccctaagtggttagaacttaataccgtaaacgtacgtgtacggtctaggcctaaccattctgttccttac

SEQ ID NO: 167299 - DNA, 539 bp, Homo sapiens
  misc_feature: GYAE6OF01EHXTR.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggtggcctggtatcagcaagaaaccaggaaacgcccctaagctcctgatctatgatgtctacaatagtagggaaagtcgggtacccagtacgaaggttcaggcggacaggtggatcgagggacagtaactcgactctacaccatcagcacgcctaacgagcctagattagtacttttcgaccgttaatttattacttcgacctaagtagtaattaagtatttacttacgtaacgtttccgaccgtaggaacctagtgtagataagtacgaaagtacgtgtacgctagccactattctgttcttac

SEQ ID NO: 167300 - DNA, 506 bp, Homo sapiens
  misc_feature: GYAE6OF01CEGXJ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccaggggaaagcccctaagctcctgatctatgatgtctccaatatggaaagtggggtcccatcgaaggttcagcggcaggtggatctgggacagaattcactctcaccatcagcagcctacagcctgactgtattttgcgtatttattattcgaccaaacagtaataagtagttattctaactttcggccctgggacctaagtgtggatatacaaacgaactgtagctgcaccatccttgtctttac

SEQ ID NO: 167301 - DNA, 523 bp, Homo sapiens
  misc_feature: GYAE6OF01DE2MI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggccatcaaggttcagcggcagtggatcgtgggacagaattcactctcaccatcagcagcctacacgtcctgatgtattttgcgtactttattattgacctaactagtaataagtagtttacgttactaacgtttccggtcccgtgggaacctaagtgtaggtatacgtactaaacgtactcggtggactcggacacctatcctgttcttac

SEQ ID NO: 167302 - DNA, 486 bp, Homo sapiens
  misc_feature: GYAE6OF01BBTWC.16.81.H04.1.454.CMB.1.raw
  modified_base (470)..(470): a, c, t, g, unknown or other
  misc_feature (470)..(470): n is a, c, g, or t
  modified_base (482)..(482): a, c, t, g, unknown or other
  misc_feature (482)..(482): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaagcccctaagctcctgatctatgatgtctccatatggaaagtgggtcccatcaaggttcagcggcagtggatcgtgggacagaattcactctcaccatcagcagcctacagcctgatgattttgacgtactttattattgactaacagtataagtagttattctaactttcggcctaggacctagtgtgattagtcaagactgngctgcacatctntctc

SEQ ID NO: 167303 - DNA, 540 bp, Homo sapiens
  misc_feature: GYAE6OF01D2954.16.81.H04.1.454.CMB.1.raw
  modified_base (512)..(512): a, c, t, g, unknown or other
  misc_feature (512)..(512): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatataggaagtgggtccagtcaaggttcagcggcagtgatcgtgggacagaattcactctacaccatacagcacgcctacagtcctagatgtagttttgacgtactttattattagacctaaacgtagtaataagtagtttacttacctaaccgtttccggacccgttagggaacctaagtgtaggattaacgtacaaagacgttggtacggtntacgtacacctattccttgttcttaccg

SEQ ID NO: 167304 - DNA, 493 bp, Homo sapiens
  misc_feature: GYAE6OF01A2TAU.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtgatctgggacagaattcactctcaccatcagcagcctacagcctgattgattttgcgtacttattattgccaacagttaataagtagttattacaactttcggaccctgggaccatgtacgatagtcaaacgactgtggctgccacatctgtcttc

SEQ ID NO: 167305 - DNA, 562 bp, Homo sapiens
  misc_feature: GYAE6OF01DWF9L.16.81.H04.1.454.CMB.1.raw
  modified_base (557)..(557): a, c, t, g, unknown or other
  misc_feature (557)..(557): n is a, c, g, or t
tcagtgtactactccacgaccggtgctcgatttagtagtgtagattcgcggggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaacgcccctaagctcctgatctatgatgtctaccaatagtaggaaaggtcggggtacccagtcgaaggttcaggcggcagtggatcgtgggacagaattcactctcaccatcagcacgcctaacgagccctgattgtattttcgacgttactttattacttcgacctaatagttaataagttagtttactttactaacgttttccggcccgttagggaaccctaagttggtaggtaattacgtaccgaaaacggtaacttaggttcggacctaggacctaccgtnttccg

SEQ ID NO: 167306 - DNA, 709 bp, Homo sapiens
  misc_feature: GYAE6OF01CSEMX.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcgccgggcagtcagagtggttggtacctgggtgcctggtatcagcaagaaaccgaggggaaacgcccctaagctccgtgatctatgatcgtctaccaatagtagggaaaggtcggggtacccagtacgaaggttcgagccggcgtaggtggagtcgtaggggaactaagtaacgtttcaccgttcctaccaacctataccgaacggacctaacggtaccccttaacgaccggtcccttaaggtaaagtttcggtttaacgtttttacggaccgtttaacttttaagttaacgttttacgaaccccttaaaagtacgttaaacgtttaaaggttaacgttttaactttacccgtaaaccgtttttaccccgggaccccgttaggggtaaacccgtaagtttacggtaacgggttaatttaaaccgtaaaccgtaaaacggtaacgttcgggtacggtcgttaaccggcctaaaccctgtttaccgttcgttccttaacccg

SEQ ID NO: 167307 - DNA, 581 bp, Homo sapiens
  misc_feature: GYAE6OF01C1LKD.16.81.H04.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtcctccttccaccctgtctgcatctgtcgganacagagtcaccatcacttcggccggcagtcaagtgtgttggtacctgggttgcctggtancagcaagaaaccagggaaacgccccgaagcctcctagtatctagtgatcgtactacaatacgtaggaaacggtcgggtaccagtcgtaaggtccaggcgganagggtgattcgtagggacaagtaacgttcacgtctacactatccatacacgcctacncgtctagtattgtagtttcgacgttactttattacgtactaccaaagtacgttaaataacggttatttaacttaccgtaaccgtttccggaccgttacggaacctaagtggtaagaattactaacgtaaacgtatacgggtcgactacggactacgtgttaccg

SEQ ID NO: 167308 - DNA, 611 bp, Homo sapiens
  misc_feature: GYAE6OF01BEW82.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgcccctaagctcctgatctatgatgtctccaatatggaaagtggggtccagtcaaggttcagcgcagtggatcgtgggacagattcactctcaccatcagcacgcctacacgcctgatgtattttgacgtacttttattacttcgaccctaaacgtagttaacttaaaggtaacgttttaactttacccgttaaaccgtttttcccgggaccccgttacgggggtaaccctaaggtttcgggttaggtaacttaaacgtaaccgtaaaaccgggtaaccgttcgggtacgggtaccttacggtaccctaacccgtatttcccgttggttcccttttacccg

SEQ ID NO: 167309 - DNA, 763 bp, Homo sapiens
  misc_feature: GYAE6OF01BWBSQ.16.81.H04.1.454.CMB.1.raw
tcagtgtactactccacgaccggtgctcgatttagtagtgtagattcgcgggggtcagactcagtcaggacacagcatggacatgagggtccccgctcagctcctgggggctcctgctgctctggctcccaggtatcaaatgtgacatccagatcgacccagtcctccttccaccctgtctgcatcgtgtcggagacagagtcaccatctacgttcgccgggccagtcagtagttggttggtaccgtgggttcggccttggtatcgagacaacgaaaccgaacgggaaacgccccgtaagcctcctgaactcgtatgatcgtactactaaatagtaggtaaacggtcgggtaccctagtacgtaaggttcgaggcggacgtaggtcggtatcggtagggacaagtaacttcgacttccacacctataccgacgtacgacgtccctaaacgacggtacctaggtaactttcggttacgttttacggaccgttaaactttttaagttaacgtttacgtaacccgttaaaacgttaacgttaaacgtttaaacggtttaaacgtttttaaccgttttaacccgttaaacccggtttttacccggggaaccccggtttaggggtaaaccccgttaaagtttacgggttacgggttaaacttaaacggttaaacccgtaaaaacgggttacggttcgggttaccggtaacccgttacggtacccttaaacccgtacggtttttccttccgttacccgttttaaccccg

SEQ ID NO: 167310 - DNA, 558 bp, Homo sapiens
  misc_feature: GYAE6OF01D9BXH.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaacgcccctaagctcctgatctatgatgtctaccaatagtagggaaaggtcggggtacccaagtcgtaaggttcaggcggcgaggtggatcgtagggacaggtaacttcgactctacacctatacagcacgtcctacagcctagtattgtattttgacttactttattattcgacctaatagtaataagtatttacttacctaacgtttccggaccgtagggaacctaagtggtagtaatacgtaccgtaaagtacgtgtacggtactacgaccactatcgttgtccttaccg

SEQ ID NO: 167311 - DNA, 533 bp, Homo sapiens
  misc_feature: GYAE6OF01A6D3Y.16.81.H04.1.454.CMB.1.raw
  modified_base (358)..(358): a, c, t, g, unknown or other
  misc_feature (358)..(358): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagcccctaagctcctgatcatgtatgtctccaatatggaaagtggggtcccatcaaggttcagcggcagtgatcgtgggacagaatcactcncacatcagccagcctacagtcctagtatgtattttgacgtatttattattgaccctaatacgtaataagtagtttaacttactaacgtttccggcccttagggacctaagtggtaggattaagtacctaaagaccgttggtggtcctaggtaccacctatttcctgttcttaccg

SEQ ID NO: 167312 - DNA, 545 bp, Homo sapiens
  misc_feature: GYAE6OF01B89LI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaagcccctaagctcctgatctatgatgtctccaatataggaaagtggggtacccatcaaggttcagcggcaggtggatcgtgggacagtaatcactctcacatcagcagcctacagcctgatgtattttgcgtactttattattcgacctaatagtaataagtagttaattacctaacgttttcggacccgttagggaaccctaagttcgtaggtaattacgtacaaaacgtaacgttggtacggactacggaccaaccctaattccgttgttcttaccg

SEQ ID NO: 167313 - DNA, 616 bp, Homo sapiens
  misc_feature: GYAE6OF01BEWK8.16.81.H04.1.454.CMB.1.raw
  modified_base (273)..(273): a, c, t, g, unknown or other
  misc_feature (273)..(273): n is a, c, g, or t
  modified_base (398)..(398): a, c, t, g, unknown or other
  misc_feature (398)..(398): n is a, c, g, or t
tcagtgtactactccacgaccggtgctcgatttagtagtgtagattcgcgggggcaggagtcagactcagtcaggacacagcatggacatgaggtcccgctcagctcctgggctcctgctgctctggctcccaggtatcgaaatgtgacatccagatgacccagtctccttccaccctgtctgcatctgtcggagacagagtcaccatcacttgccgggccagtcagagtgttggtacctggttggcctggtatcagcagaaaccagggaaancccctaagctcctgatctatgatgtctaccaatagtaggaaagtggggtacccagtacaaggttcagcggcaggtggatcgtgggacagaacttcgaactctacacctatcgagcagacctaacncgcctagacttgtacgttttcgacgttaactttattaacgtttcgaacctaaactaggttaaacttaaggtaacgttttaacgttaccgttaaaccgttttccgggacccgttaggggtaaacccctaagttaccggtaagggtaacttaacggttaaccgaaaacccggtaacgttcggtacgggtacccttaggaccctaaccgtaactttcccgg

SEQ ID NO: 167314 - DNA, 544 bp, Homo sapiens
  misc_feature: GYAE6OF01BYKC0.16.81.H04.1.454.CMB.1.raw
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggctggtatcagcaagaaaccgaggggaaacgcccctaagctcctgatctatgatgtctacaatatgggaaaggtgggtacccagtacgaaggttcagcggngaggtggatcgtagggacagtactcactcnccacatcagcacgacctacncgtctagattgtattttggacgttactttattacgttcgacctaagtagtaataagtagttacttacctacgtttccggaccgtacggactaagtgtagtataactacgtaaagacgtgtacgtctacgacctactatcttgttccttacg

SEQ ID NO: 167315 - DNA, 525 bp, Homo sapiens
  misc_feature: GYAE6OF01EL9Y4.16.81.H04.1.454.CMB.1.raw
  modified_base (225)..(225): a, c, t, g, unknown or other
  misc_feature (225)..(225): n is a, c, g, or t
  modified_base (336)..(336): a, c, t, g, unknown or other
  misc_feature (336)..(336): n is a, c, g, or t
  modified_base (497)..(497): a, c, t, g, unknown or other
  misc_feature (497)..(497): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgcccgggccagtcagngtgtttggacctggttggcctggtatcagcagaaaccaggggaaacgcccctaagctcctgatctatgatgtctcaatatggaaagtggggtcccatcaaggttcagcggnagtgatctgggacagaattcactctcacatcagcagcctacagcctgatgtattttcgcgtactttattattcgaccctaaagtagtaattaagtagtttaacttactaaccttttcggccctgggaacctaagttgtaggatacgtacaaacgtacgtgnggtcgtcgaccaccattccttgtcttac

SEQ ID NO: 167316 - DNA, 571 bp, Homo sapiens
  misc_feature: GYAE6OF01CDN5T.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccaggggaaacgcccctaagctcctgatctatgatgtctccaatagtaggaaagtcggggtcccagtcaaggttcagcggcaggtggatcgtgggacagaattcactctacaccatcagcagccctacgacgcctgaattgtatttttggaccgttactttaagtttacttacgaccctaaacgtagttaataaggtaagttttacttacgttaaaccgttttccggacccgttagggaacctaagtggtagaattacgtacaaacgtaacgttggtacggctacggaccacctattccttgttccttaccg

SEQ ID NO: 167317 - DNA, 653 bp, Homo sapiens
  misc_feature: GYAE6OF01AE9WK.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttcggtacctggttggccttggtatcgagcaagaaaccgagggaaacgcccctaagctcctgatctatgatgtctacaatagtaggaaggtcgggtaccagtacgaaggttcaggcggctaggtggactcggtaggacagtacttcactctcaccatcagcacgaccctaacgcgtccgttagtacgtttagtactttttcggaccgttaaccttttaagtttacgtttacgaacccttaaagtaacggtttaaacttaaaggttaagttttaacctttaaccgttaaaccgttttcccgggacccgtttacggggaacccgttaagttcgggttaaggtacttaacgttaaaccgtaaaaccggtacgttcgggttaccgggtctacggtaccctaacctacgttaccttcggttcctttacccg

SEQ ID NO: 167318 - DNA, 561 bp, Homo sapiens
  misc_feature: GYAE6OF01EELJM.16.81.H04.1.454.CMB.1.raw
  modified_base (268)..(268): a, c, t, g, unknown or other
  misc_feature (268)..(268): n is a, c, g, or t
  modified_base (553)..(553): a, c, t, g, unknown or other
  misc_feature (553)..(553): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccgggccagtcagagtgttggtacctggttgcctggtatcagcaagaaccagggaaacnccctaagctcctgatctatgatcgtctaccaatagtaggaaaggtcgggtacccagtacgtaaggttcacggcggcgaggtggatcgtagggacagtaactcactctacacatcagcacgcctaacacgtctagtattgtatttcgacttactttattatcgacctaagtagttaagtaagtagtttacttacgttaaccgtttccggacccgttagggaaccctaaggttcggtagaagttacgtaacgtaaacgtagtggtacgctacgtaccactagttctntcgttacc

SEQ ID NO: 167319 - DNA, 576 bp, Homo sapiens
  misc_feature: GYAE6OF01BR8N5.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatacaaggttcagcggcagtggatcgtgggacagattcactctcacatcagcagcctacagcctgatgtattttcgacgtactttattacttcacctaactagtaactaagtagtttaattaccgtaaaccgttttccggaccccgttaggggaaccctaaagttcggtaggtaacttacgtaaccgtaaaaggtaaccgttgggtacgggtccttacggtaccctaacccgtaagttccgtttggttcccttttaccg

SEQ ID NO: 167320 - DNA, 582 bp, Homo sapiens
  misc_feature: GYAE6OF01C5D6Q.16.81.H04.1.454.CMB.1.raw
  modified_base (276)..(276): a, c, t, g, unknown or other
  misc_feature (276)..(276): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttgtacctggtgcctggtatcagcaagaaacaggaacgccctaagctccngatctatgatgtctaccaatagtaggaaagtggggtcccagtcaaggttcagcggcagtgatcgtgggacagtattcgactctacacatccagccagtcctacagtcctagtatggtattttgaccgtactttattattacgacctaaactaagttaagttaaacgtagttttaacttacgtaaccgtttccggacccgttagggtaaccctaagtttcggtaggtaacttagtaaccgaaaacgttaaccgttggtaccgggtactacggtacctaacccgtatttaccgtgtttccgttacccg

SEQ ID NO: 167321 - DNA, 568 bp, Homo sapiens
  misc_feature: GYAE6OF01CIEQR.16.81.H04.1.454.CMB.1.raw
tcagtgtactactccacgaccggtgctcgatttagtagtgtagattcgcgggggcaggagtcagactcagtcaggacacagcatggacatgaggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccgagggaaacgcccctaagctcctgatctatgatgtctaccaatagtaggaaagtcggggtacccagttacgaaggttcaggtcggacaggtggaatcgtgggacagtaattcactctacaccatcagcacgcctacagtcctagattgtattttgacgttactttattacgttcgaacctaaacgtagtaagttaagttagtttaacttactaacgtttccggacccgttagggaacctaagttgtaggtattaacgtaacgaaacgtacttcggtacggcctaggaccctacgtagttccg

SEQ ID NO: 167322 - DNA, 559 bp, Homo sapiens
  misc_feature: GYAE6OF01DQPXL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgcccctaagctcctgatctatgatgtctacaatataggaagtcgggtccagtacgaaggttcaggcggacaggtggagtcgtagggacaagacttcactctacacatcacgcacgacctacacgtcctagtagtagttagtttacgtacgtacttattattacgtactaactagatttttttaagagtttattacgtaactttccggtaccgtacggaaccgtaatgtagtataagtacgtaaacgtaacgtaggtcgtacgtacgtaccaactattcgtgttcttacc

SEQ ID NO: 167323 - DNA, 725 bp, Homo sapiens
  misc_feature: GYAE6OF01C6NXI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccacctgtctgcatcgtgtcggagacagacgtcaccatctacgttcggcccggcagtcaggtagttggttacggtaccgttgggttcggtccgttggtactacgagacgaaacggaaaccgaacggggaaaccgaccccgtaagcctccgtagactctagtgtacttcgtacctactaagttaggtaacgggtaaacggtccggggtaccctaagttaccggtaacggttccgacggtccgggtacgtagggtcggtacgtcggtaacggggtaactaacggttaacttaccgtacgttaccctaccgaacctacgtaaccgaacggaccgtaaccgtaccctaacgacgttccgtaagttacgttacgtttacgtttcggacctttaatttatttacgtaccgaaccgtaaagttaagttaaacgttaagttacgttttaactccgttaaccgtttcccgggaccgttaggaaccttagttcggtagtaacttaagtaaccgtaaacggtagttcggtcggtactacgacctaactatttccgtgttcccttaccg

SEQ ID NO: 167324 - DNA, 489 bp, Homo sapiens
  misc_feature: GYAE6OF01A3RN6.16.81.H04.1.454.CMB.1.raw
  modified_base (412)..(412): a, c, t, g, unknown or other
  misc_feature (412)..(412): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatataggaaagtggggtcccatcaaggttcagcggcagtggatcgtgggacagaattcactctcaccatcagcagcctacacgcctgatgtattttgctattattattgcaanagtataagtagttattctaactttcggcctaggacctaatgtagatagtcaaagactgagctgcacatctgtcttac

SEQ ID NO: 167325 - DNA, 722 bp, Homo sapiens
  misc_feature: GYAE6OF01CZ9U8.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccaccctgtctgcatctgtcggagacagagtcacatcacttcggccggcagtcagtagtgttcggtaccttgggttcggcctaggtatccgagacgaaacggaaaaccgaacggggaaaccgtaccccctaaaggccttaccgtagtaacttccttaagtcggtaattcgttacctaacctaaagttaacggtaggggtaaaacggttccggggttacccaagttacgtaaggttcgacggtcggacgtaggtaggacgtcggtagggaactagtaacttccgactcctaccgactatccgagtaccaccgtacctaacgtacgtaccgttagtaacgtttagttacgtttttcggaacgtttaactttacgttaagttaccgaactaaacgttaagttaacgttaaaggtttacttttaaccgttaccgttaaccggtttcccggacccgttaacggaaccttaggttacggtaggtaacttaaccgtaacggtaaacgtacggttcgggtacgtcgtacgtaacctacgtatttcttcgttcctttacccg

SEQ ID NO: 167326 - DNA, 499 bp, Homo sapiens
  misc_feature: GYAE6OF01DI7C4.16.81.H04.1.454.CMB.1.raw
  modified_base (481)..(481): a, c, t, g, unknown or other
  misc_feature (481)..(481): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggcctggtatcagcagaaaccagggaaagcccctaagctcctgatctatgatgtctccaatagtagggaaagtggggtcccatcgaaggttcagcggcaggtggatcgtagggacagtattcactctcaccatcagcagcctacagtcctgtatgtattttgacttattattattcgaccaatagtataagtattattctacttcgccgtggacagtgtgtatatacaaagtactgtcgntgacactatctgttctac

SEQ ID NO: 167327 - DNA, 520 bp, Homo sapiens
  misc_feature: GYAE6OF01AKJM9.16.81.H04.1.454.CMB.1.raw
  modified_base (483)..(483): a, c, t, g, unknown or other
  misc_feature (483)..(483): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcgagtggatcgtgggacagaattcactctcaccatcagcagcctacagcctgatgtattttgcgtactttattattcgaccaactagtaattaagtagtttacttactaaccgtttccgggacccttagggacctaagtgtaggacttanacgaaacgagttgtcggctgcacatctgttcttctac

SEQ ID NO: 167328 - DNA, 676 bp, Homo sapiens
  misc_feature: GYAE6OF01BK542.16.81.H04.1.454.CMB.1.raw
  modified_base (191)..(191): a, c, t, g, unknown or other
  misc_feature (191)..(191): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttcggccgggcagtcaggtagtggttcggtaccgtgggttcggccgtggtactcgagacgaacgaaaccgagggaaaccgtacccctaaggcctccgtagtactctagtgattcgtactacctaatagtaggtaaaggtcggggtaccctaagtacgtaaggttcgaacggcggacgtaggtggtacgtcggtagggtaacaaggtaacttccaacttctacacctactacgacgacacgtaccctaacgacgtcctagtacttagttacgtttcgaacgttactttaagttacttacgacctaaagtaagttaataaaggttacgtttaacttaaccgttaaccgtttcccgggtacccgttagggtaaccctagttaggtacggtaaacttaacgtaaccgtaaaaccgtagttcggtaccggtattaccggtaacctacgttaacttccgttagttcctttacccg

SEQ ID NO: 167329 - DNA, 653 bp, Homo sapiens
  misc_feature: GYAE6OF01ADDXM.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatcgacccagtcctccttccaccctgtctgcatctggtcggagacagacgtcaccatcacgttcggccgggccagtcgagtagttggttcggtaccgttggttcggccttggtactcgagacgaacgaaaccgagggaaaccaccccgtaagcctctagattactagtgattcgtactacgtaagtagtaggtaacggtcgggtaccagtacgtaggtcgacggcggacgtaggtcggtagtcggaggaactaagtacttccgaaccttcctacctactaacgtccgaacgtccaaccgtccctaacgacgtcctaggtacttacggttaacttttcgacgtttaattttacgttacgtaacctaaccgtaaagttagttaacgttaaggttacgtttacttaacccggtacgtttcccggaccggtacggtaacctaaggtgtaacggtaatacgtaacgtaaccgtagtggtacgtctacgcttacgtcgttcg

SEQ ID NO: 167330 - DNA, 549 bp, Homo sapiens
  misc_feature: GYAE6OF01C3RP8.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagcctcctgatctatgatgtctccaatatggaaagtggggtcccagtcaaggttcaggcggcagtggatcgtgggacagattcactctcacatcagcagcctacagcctgatgtattttgctactttattattcgaccaatagtaattaagtagtttattactaaccgtttcggaccccttagggaaccctaagttcggtaggtattaacgtaccgaaaacggtacgttggtcggtacttcggacctaacctagttccttgttccctttaccg

SEQ ID NO: 167331 - DNA, 579 bp, Homo sapiens
  misc_feature: GYAE6OF01DQNM9.16.81.H04.1.454.CMB.1.raw
  modified_base (381)..(381): a, c, t, g, unknown or other
  misc_feature (381)..(381): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgtcgggccagtcagagtgttggtacctggttggcctggtatcagcagaaaccagggaaacgccctaagctcctgatctatgatgtctcaatataggaaagtgggtccatcaaggttcagcggcagtgatcgtggacagaattcaactctacacatcagacacgtcctacncgacctgatgtattttcgcgtactttatttattcgacctaatagttaactaagtagtttattaccgtaacgtttccggacccgttgggtaaaccctagttacggttagggtaattaacgtaaccgtaaaacggttaacgttacgggttacgggtaccttacggaaccctacccgttaacgttccgtttcggtttaccc

SEQ ID NO: 167332 - DNA, 946 bp, Homo sapiens
  misc_feature: GYAE6OF01DZEIL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacgagacgtacaccatctacgttcggccgggactagtacgaggtaggttcggttacggttaccgttgggttcggtccgttaggttactacgaacgaccgaaaacggaaaccggaacggggaaacccgtaccccgtaaaggtcccttaccgttacggtaactttacgtaagttacggtaacgtttcggttacccttaaccgtaaagttaacgggttaacggggtaaaacgggttccggggttaacccctaaaggttaccggttaaaacggggttccgaacgggtccggtaacggtaagggttacggtaacgtttacggtaacggggaaacgtaacggttaaactttaccgaaccgtttaccgtaacctaacccgtacttaccgaacgtaccgtaaccggtaccctaacggtacgtaccgttaggtaacgtttagtttacgttttacggtaaccgtttaacgtttttaacgttaaccgttaccgtaaaacgttaaaccgtttaaggtttaaacggttttaaacggttaaacgttttttaacccgtttaaacccggttttaaacccggttttaccccggggtaaaccccggttaacggggtaaaacccttaagggtttaccggttaaagggtaaaacccgttttaaacgtaaaacccggtaaaacgggttaaccggtttaggggttaccggttaaacccggtccgttaaacccttaaccggttaccttttaccggtttccggtttacccgtttaaccc

SEQ ID NO: 167333 - DNA, 687 bp, Homo sapiens
  misc_feature: GYAE6OF01CRNY8.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatacaaatgtgacatccagatcgacccagtcctcccttcccaccctgtctgcatcgtggtcggagacagacgtccaccatcacgttcggccgggccagtcgagtagtggttcggtaccgtgggttcggccgtggtactcgagacgaaggaaaccgagggaaccgtaccctaagcctcctagtactactatgacttcgtctacaagtagtagggtaacggtcgggtacccagtacgaaggttcgacggcggacgaggtggacgtcggtagggactaagtacttcgactcctacacgatcgacgtacaccgtacctacgacgtacctaggtaactttggttaaccgttttcggaacgtttaacttttagtttaacgttaccgtaaccctaaagttaagttaacgttaaacgtttacgtttaaccttacccgttaacccggtttacccgggtaccccgttagggtaacctaggttccggtaaggtaacttaaccggaacgtaaaccgtagttcggtacgacctacgtaccctacttattccgttcttccgttacccg

SEQ ID NO: 167334 - DNA, 593 bp, Homo sapiens
  misc_feature: GYAE6OF01BAEYE.16.81.H04.1.454.CMB.1.raw
  modified_base (271)..(271): a, c, t, g, unknown or other
  misc_feature (271)..(271): n is a, c, g, or t
  modified_base (375)..(375): a, c, t, g, unknown or other
  misc_feature (375)..(375): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttgtacctggttggcctggtatcagcagaaaccagggaaacncccctaagctcctgatctatgatgtactaccaatagtaggtaaaggtcggggtaccatacgaaggttcaggcggcgaggtggatcgtgggacagaattcactcncacatcagcagaccctacagcctgatgtaattttgacgttaactttattacgttacgacctaaacgtagtaattaaagtacgtttaactttaccgttaaccgttttcccgggaccccgttagggtaaccctaagttaggtacggtaaattaacgtaactaaaccggtaacgttcggttacggacgttacgactaaccttacttccgtttcgttacccg

SEQ ID NO: 167335 - DNA, 601 bp, Homo sapiens
  misc_feature: GYAE6OF01D8G7J.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttgtacctggttggcctggtatcagcaagaaaccagggaaacgcccctaagctcctgatctatgatgtctccaatagtaggaaagtgggtacccatcaaggttcaggcgcagtggatcgtgggactagaattcactctcaccatcagcaacgcctacagcctagatgtattttgacgtactttagttactttacgacctaaatagttaagtaaagtagttttaacttaccgtaaacgttttcccgggaccccgtttaggggaaaccctaagtttacggtacgggtaaactttaacgtaacccgtaaaaccggtacgttaggtacggtacgttaccgacctaaccccttagttccccgttgttcccgtttaacccg

SEQ ID NO: 167336 - DNA, 544 bp, Homo sapiens
  misc_feature: GYAE6OF01EQGR4.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtccatcaaggttcagcggcagtgatcgtgggacagaatcactctcaccatcagcagcctacagcctagatgtattttgcgtactttattatgacctaacagtaataagtacgtttaattacctaaactttccgggcccttagggaaccctaagttggttagaatttacgtactaaaaccggtaacttcgggtaggtcgtacgccctaaccctattccttgttcctttaccg

SEQ ID NO: 167337 - DNA, 585 bp, Homo sapiens
  misc_feature: GYAE6OF01DTO49.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcacttgccgggcagtcagtagtgttggtaccgtgggttggcctggtatcgagacaagaaaccgagggaaacgccccgtaagcctcctagatctatgatgtctacaatagtaggaagtcgggtaccagtacgtaaggtcaggcggacgtaggtggagtcgtagggaactaggtaacttcacttctaccaccatccacgacgacgtacctacgacgtcctagacttagttattttcgacgttaactttatttacgttacgacctaaagtagttaagtaagttagtttacttaccgttaacgtttccggaccgttaggaacctagtgtagtaactagtactaaagtactggtacgtctcgtactactagtcttcgttcttacg

SEQ ID NO: 167338 - DNA, 528 bp, Homo sapiens
  misc_feature: GYAE6OF01EFW4C.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctccaatagtaggaaagtgggtcccagtcaaggttcagcggcaggtggatcgtagggacagaattcactctcaccatcagcagcctacagcctgatgtattttcgcgttaactttattattgaccctaatagtaataagtagtttattactaactttccggacccgtaggaccaagttgtaggaattagactaaacgactggtacggctcggtacctactattctgtcttacc

SEQ ID NO: 167339 - DNA, 532 bp, Homo sapiens
  misc_feature: GYAE6OF01A4DHI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaacccaggggaaacgcccctaagctcctgatctatgatgtctccaatatggaaagtgggtcccatcaaggttcagcggcagtggatcgtgggacagaattcactctcacatcagcagcctacacgcctgatgattttgcgtatttattattgaccaactagtaataagtagttattactaacgtttcggacccgtagggaacctaagtggtaggaattagtaccgtaaacgaacgttgtacgggtctacggactacccattctcggttcttaccg

SEQ ID NO: 167340 - DNA, 506 bp, Homo sapiens
  misc_feature: GYAE6OF01BTBVI.16.81.H04.1.454.CMB.1.raw
  modified_base (413)..(413): a, c, t, g, unknown or other
  misc_feature (413)..(413): n is a, c, g, or t
tcagtgtactactccacgaccggtgctcgatttagtagtgtagattcgcgggggtcagactcagtcaggacacaacatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgtattttgcgtacttattattgcctaanagttaataagtagttacttacgtaactttcggcccttgggaccaagtcgtgatatacaaacgaatggtggctgacaccatcttgtcttcgtac

SEQ ID NO: 167341 - DNA, 498 bp, Homo sapiens
  misc_feature: GYAE6OF01EB9W6.16.81.H04.1.454.CMB.1.raw
  modified_base (268)..(268): a, c, t, g, unknown or other
  misc_feature (268)..(268): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaancccctaagctcctgatctatgatgtctccaatatggaaagtggggtacccntacaaggttcagcggcagtggatcgtgggacagaatcactcncaccatcagcagcctanagcctagactgtaattttggccgtactttattattgacctaacagttaataagtagtttattacaacgtttcgaccgtggaccatcgtgatatcaaagacngtgctgcacatctgtntac

SEQ ID NO: 167342 - DNA, 672 bp, Homo sapiens
  misc_feature: GYAE6OF01CEIFM.16.81.H04.1.454.CMB.1.raw
  modified_base (192)..(192): a, c, t, g, unknown or other
  misc_feature (192)..(192): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatcgtgtcgganacagagtcaccatcacgttcggccgggccagtcgagtagttcggttaggtaccgttgggttggccgttagggtactccgaagaccaaacggaaaaccgacggggaaaacctcccccgttaaaggcccttaccgtagtaacttctaagtcgtatcgtcctaacctaagtagtaagggtaaacggtcggtacccaagttacgaaggttccaggcggactaggtcgatcgtagggaactagtaacttcactcacactactcgacgtcacgtacctacgacgtacctagtaacttgttacgtttcggactttacgtttaatcgtacgaacctaaacgtaggtaacttaacggttactttacttacccgtaaccgtttccgaccgttacgggaaccttaggttcggtaacggtacttaacgtaccgtaaaagttcgtcgttacggtaacacggtaccctaactatttacctcggttcttaacccg

SEQ ID NO: 167343 - DNA, 542 bp, Homo sapiens
  misc_feature: GYAE6OF01CA3XL.16.81.H04.1.454.CMB.1.raw
  modified_base (267)..(267): a, c, t, g, unknown or other
  misc_feature (267)..(267): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggtgcctggtatcagcagaaaccagggaaacncccctaagctcctgatctatgatcgtctccaatatggaaagtgggtcccagtcaaggttcagcgcagtgatcgtggacagatcactcncacatcagcagcctacgngcctagattgtagttttcgacgttaatttatttatacgaccctaaagtaagttaattaaaggtagtttactttacgtaaccgttttccgggacccttagggaaccctaagtcggtagtaatactaccgaaaagtactggtcgtactgacctaaccattcttgtctttac

SEQ ID NO: 167344 - DNA, 621 bp, Homo sapiens
  misc_feature: GYAE6OF01CP52J.16.81.H04.1.454.CMB.1.raw
  modified_base (271)..(271): a, c, t, g, unknown or other
  misc_feature (271)..(271): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctggtcggagacagagtcaccatcacgttcgccggcagtcagtagtgtgtactggttgctggtatcagacaagaaaccgagggaaacncccctaagcctactgatctatcgatctactacaatagtagggtaaacgtcgggtacccagtacaagggttccaaggcgagaggtagatcgtaggacaagtactcgactctacactataccagtccacgtctaacgacgtacctaggaactttagtaagtttttccgggacttaaccttttaagtttaccgttacggtaacctaaaacgggttaaggtttaaactaaaggtttaacgtttaactttacccggtaaaccgttttcccgggaaccccgtagggtaacctaagttggacgtaataccgtacgaaacgtagttcgagttcgagtacccatacttctcgttctacc

SEQ ID NO: 167345 - DNA, 595 bp, Homo sapiens
  misc_feature: GYAE6OF01EFIH4.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttgcctggtatcagcagaaaccagggaaacgcccctaagcctcctgatctatgatgtcctaccaatacgtaggaaaggtcggggtacccaagttacgaacgggttcaaggtcggacaggtggactcggtaggggaactaaggtaacttcgaacctctaccaaccctataccgaagtccaacgtcccttaaacgacgtccctaggaattgtagttttcgacgttaactttattattcgaaccaatagtaataagtactttacttctaaccgtttcgaccgtagggaacctaagtcgtagtaattacgtaaacgaaacgtactggtacggtactacgaccctactattccgttgtccttac

SEQ ID NO: 167346 - DNA, 686 bp, Homo sapiens
  misc_feature: GYAE6OF01DIG5K.16.81.H04.1.454.CMB.1.raw
  modified_base (273)..(273): a, c, t, g, unknown or other
  misc_feature (273)..(273): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtggttggtacctggttggcctggtatcagcaagaaacagggaaacnccctaagctcctagactctatgatgtctcaatataggaaagtcgggtacccagtacaaggttcaggcggcgaggtggagtcgtagggaacaggtaaacttcgtaacttctaccgaacctacgttaccacgaccgtaacgtccctaacgtacgtacccttaggactttagttagttttcgaccggttacttttatttaacgttacgaacctaacgttaagttaagttaaaggttaacgttttaactttaccgttaacccgtttttaccggggacccgttaacggggtaaacccttaaagttacggggttaagttaaacgttaaacgtaaccgtaaaaacggtttaaccgttacggttacgggtacccgttaaccgtaacccgtaaccgtaacgtttccgtttcgtttaaccccg

SEQ ID NO: 167347 - DNA, 626 bp, Homo sapiens
  misc_feature: GYAE6OF01BEYEG.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttcgcctggtatcagcaagaaaccgaggaaacnccctaagctctgatctatgatcgtctacaagtagtaggaagtcgggtacccagtacgtaagttcgagcggacgtaggtgagtcgtagggaactagtacttcacttcacaccataccgagaccacgaccctaagcgtccgtagtacgttagttattttacgcgttaactttagttacgttacgaaccttaaacgtagtttaaactaaggttaacgttttacttaccgttaaaccgtttccggaacccgttagggtaaacctaaggttcggtagtaaataacgtaaccgtaaaccggttacgtcggtacggtactaaccggtaccctaacgtactttccttacggttcctttaacccg

SEQ ID NO: 167348 - DNA, 643 bp, Homo sapiens
  misc_feature: GYAE6OF01C4C1L.16.81.H04.1.454.CMB.1.raw
  modified_base (193)..(193): a, c, t, g, unknown or other
  misc_feature (193)..(193): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccaccctgtctgcatctgtcgganacagagtcaccatcacttcgccgggccagtcagagtgtggtactggtggctggtatcagcaagaaacagggaacgcccctaagctcctgactctaatcgtatgtctaccaatacgtagggaaaggtcgggtacccaagtccgtaaggttcgagcggctaaggtgagtcgtagggaactaagtacttacacctctaccactactacacgcgaactacctacgacgtacctagtagttcgttagtttacggccgttaaactttacgtttaacttacgacctaaactaagtttaaagttaaggttaacgttttacgtttaaccgttaaccggttttacccgggtacccccgtagggtaacccgtaaagttcgtaagggtattaacgtaaccggtaaaagtacgttagggtccgtacgtacgacctaaccgttattacgttcgttaccgttacc

SEQ ID NO: 167349 - DNA, 501 bp, Homo sapiens
  misc_feature: GYAE6OF01DTTJO.16.81.H04.1.454.CMB.1.raw
  modified_base (410)..(410): a, c, t, g, unknown or other
  misc_feature (410)..(410): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtactggtgctggtatcagcaagaaaccaggaaagcccctaagctcctgatctatgatgtctccaatataggaaagtgggtcccatcgaagttcgagcggcagtggatcgtgggacagacttcactctcaccatcagcagcctacagctagattgtattttgcgtatttattatgaccaanagtaataagtagttattctaacgtttcgcctaggacctaagtgtagtatagtacaaagtactggcgtctacgcacctattcgtgtccttac

SEQ ID NO: 167350 - DNA, 589 bp, Homo sapiens
  misc_feature: GYAE6OF01B66H2.16.81.H04.1.454.CMB.1.raw
  modified_base (372)..(372): a, c, t, g, unknown or other
  misc_feature (372)..(372): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttcggtactggttggcctggtatcgagcaagaaaccagggaaacgcccctaagctcctgatctatgatgtctaccaatagtaggaaagtcggggtacccagtcgaaggttcagcggcaggtggatcgtagggacagtattcactcncacatcagcacgcctacacgtcctagattgtatttgacttaactttattacttcgaccctaataagttaactaagttaacgtttattaccgtaacgttttaccgggtacccctagggtaacccaaagttggtacggtaacttaacgtaccgtaaaaccggtaacgttcggttacggtaccttacggacctaccgtaattccgttgttccttttaccg

SEQ ID NO: 167351 - DNA, 548 bp, Homo sapiens
  misc_feature: GYAE6OF01CM3DR.16.81.H04.1.454.CMB.1.raw
  modified_base (253)..(253): a, c, t, g, unknown or other
  misc_feature (253)..(253): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggcctcccaggtatcaaatgtgacatccagatgacccagtctccttccaccctgtctgcatctgtcggagacagagtcaccatcacttgccggccagtcagagtgttgtactggtgctgtatcancagaaacaggaaacgccctaagctctgatctatgatgtctacaatatggaaagtcggggtacccatacgtaaggttcaggcggcaggtggatcgtagggacaagaattcactctcaccatcagcagcctacgagcctgatgtatttcgacgtaactttatattcgaccaaactagtaattaaagtaacgtttaattaccgtaaactttccggacccgttacgggaaaccctaaagttcggtaagaattaatacaaaaaccgtacgtagttcggcttagactaacccgatttaccg

SEQ ID NO: 167352 - DNA, 730 bp, Homo sapiens
  misc_feature: GYAE6OF01DFT0U.16.81.H04.1.454.CMB.1.raw
  modified_base (286)..(286): a, c, t, g, unknown or other
  misc_feature (286)..(286): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatcgtgtcggagacagacgtcaccatctacgttcggccgggccagtcagtagttgttcggtacctgggttgccgtggtatcgagacaacgaaaccgagggaaaccncccctaagcctccgtagatctagtgattcgtctacctaatagtaggtaaacggttcgggtacccaagtcgtaaggttcacggcgacgtaggtgagtcgtagggaactaagtacttcacttcctaccacctatccgaagtaccaacgtacccctaagaccgtccttaggtaagtttcgtttaacgttttcgaaccgtttaaactttgttttaacgtacccgtaacctaaacgttagttaaagtttaaacgtttacgttttaaacctttaccgttaacccgtttcccggacccggtttaagggaacccttaaagtttcgggtaaagggttaaaccttaacggtaaaacccgtaaaaagggttccgtttacggggttaccggtaccgttaacggtacccccttaaagttacccgtttccgtttaaccgtttcccgttttaaaccccg

SEQ ID NO: 167353 - DNA, 628 bp, Homo sapiens
  misc_feature: GYAE6OF01CS32D.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggtgctggtatcagcagaaaccagggaacgacccctaagctcctgatctatgatcgtctaccaatacgtaggaaaggttcggggtacccaattacgaaggttcgaggcggactaggtggatcgtgggacaagtaacttcactctcactatcagcacgcctaacgacgtcctagtaactgttatttcgacttacgtttaattactttgaacccgtaagtagttaagttaagttaggtttaacttccgttaaaccgtttccgggtaccccgttacgggtaacccgttaaagtacgggttaggtaagtttaacgtaaacccgtaaaaggtaacccgttggtaacgggtcccttacggaaccctacccgtaattacccgttggtttccctttacccg

SEQ ID NO: 167354 - DNA, 573 bp, Homo sapiens
  misc_feature: GYAE6OF01A1ELH.16.81.H04.1.454.CMB.1.raw
  modified_base (286)..(286): a, c, t, g, unknown or other
  misc_feature (286)..(286): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccgggccagtcagagttgttggtacctggttggcctggtatcagcagaaaccagggaaagcccctaagctccngactctatgatgtctaccaatatagggaaaggtcggggtcccatacgaggttcagcggcaggtggatcgtagggacagtaattcgacctcgtacactatcgagcacgccctaagacgcctagattagttagttttggaccgttatttacgttattcgacccaaagtacgttaattaacggtagtttacttactaaccgtttcggacccctaagggtacctaagttggttagactaactacgtaaacggacttgcggtacctacggaccaacttcttcgttcgttccg

SEQ ID NO: 167355 - DNA, 629 bp, Homo sapiens
  misc_feature: GYAE6OF01DPJ5P.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatctacttcggccggccagtcagagtgttcggtactgggttgcctggtatcgagcaagaaaccgagggaaacgcccctaagctcctagatctatgtatcgtactacaagtaagtaggtaaaggtcggggtacccaagtaccgtaagggttaccaggtcgggacgaggtaggtagtcgagggactaagtaacttcaactcgtaccactagtaccagacgacgtaccctaacgacgtacccgtagtaattaggtacttttaggtacgttaactttatttaagttccgaacctaagtaacgttaagtaaacgtagtttaacttacttaaccgtttccggaccctagggtaacctaggttagacggtaatacgtaacgaaaccgtaacgtggtacggtcacggtacctacgtaatccgttgtcctttaccg

SEQ ID NO: 167356 - DNA, 561 bp, Homo sapiens
  misc_feature: GYAE6OF01DXEXZ.16.81.H04.1.454.CMB.1.raw
tcagtgtactactccacgaccggtgctcgatttagtagtgtagattcgcgggggtcagactcagtcaggacacagcatggacatgagggtccccgctcagctcctgggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatataggaaaggtcgggtcccatcgaaggttcaggcggcagtggatcgtagggacagattcactctacacatcagcagcctacagtcctagatgtagttttcgacgttactttatttattcgacctaacgtaagtaattaaagtagttttataccttaaccgttttccggacccgttagggaacctaagttggtacggtattaactacgtaaaacgtacgttggtacgggctacggacctaacctatccttgttcttaccg

SEQ ID NO: 167357 - DNA, 616 bp, Homo sapiens
  misc_feature: GYAE6OF01DJNNT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccggcagtcagagtgttggtacctggtggcctggtatcagcagaaaccgagggaaacgcccctaagctcctgatctatgattgtctaccaatagtaggtaaaggtcggggtaccctaagtacgtaaggttacaggcggacgaggtaggactcgtagggacaagtaacttccaactctacgaacctactacgaacgccaacgtccctaacgacgtcctagtaacttgttacgttttgaccgttactttattattcgaacctaacgtaagttaaataaggtaacgtttaacttaccgtaaccgtttccggacccgttaggggaacctaaggttgtaggtaattaacgtaacgtaaaagttacgttggtacggtcacgtacccaacttacgtctttcgtctttacccg

SEQ ID NO: 167358 - DNA, 722 bp, Homo sapiens
  misc_feature: GYAE6OF01D0SJT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcacttgccgggccagtcagagtgttggtacctggttggcctggtatcagcaagaaaccgaagggaaacgcccctaagcctcctgatctatgatgtctacaatagtaggaaacggttcggggtaccctaagtaccgtaaggttcgaggcggactaggtggatcggtaggggaactaaggtaaactttccgaacgttcctaccaacccgtaacttccgaacgaccgtaacgtaccccttaacgaacgtcccgtaaggttaacttacggtttacgtttttcggaacctttaacggttttaatttacgttacgtaacccgtaaactaaggtttaagttaaacggttaattttaacgttttaaccgttaaacccgtttttccggggaccccgttaaggggtaaccctaaagttcgggttaacggtaaattaaccgtaaaccggtaaaaaccggttaacggttcggttacgggacccgtttacggaacctaacccgttatttccgttagttccctttaacccg

SEQ ID NO: 167359 - DNA, 557 bp, Homo sapiens
  misc_feature: GYAE6OF01BDMZJ.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaaccgagggaaacgcccctaagctcctgatctatgatgtctaccaatatagggaaagtgggtacccatcgaaggttcagcggcaggtgagtcgtggaacagtaactcacgtctcacctatcagccacgcctaacacgcctaggtactgtattttgacgtactttattatcgacaactagtaataagtagttaattccgttaacgtttccggacccgtaggaacctagttaggtacgtaagttaacaaccgtaaacgtacgtggtcggtacacgtacacctattcgttgttccttaccg

SEQ ID NO: 167360 - DNA, 780 bp, Homo sapiens
  misc_feature: GYAE6OF01BUZ13.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctcccttccaccctgtctgcatctgtcggagacagagtcaccatcacgttcgccgggccagtcagtagtggttggtacctggttgccgtggtactcgagacaagaaaccgagggaacgaccccgtaagccgtacctagacgttctaagttgacgttacgtacctacctaagtagttacgggtaaaggttcggggtacccaagttacgtaacggttacgacggtcggacgtaggtgggtaactcgggtacggtaacgaacggttaaactttacccgtaaacgttcccgtaaccgtaacccgtaactaccgaacgggttaacccaaccggtaaccccgttaaaccgtacggtacccgtaaggttacgtttagttaacgtttttccggaacgtttaaacccttttaagttaccgtttaccgaacccgttaaataaacggttaaactttaaacggttaacgttttaacgtttaacccgttaaccgttttaccccgggaacccgttacggggtaaacccttaaggttacggtaacgggtaaacttaacggtaaccgtaaacggttacgtcgggttacgtacgttcgtaaccctactaccgttcttaccggttctttaacccg

SEQ ID NO: 167361 - DNA, 526 bp, Homo sapiens
  misc_feature: GYAE6OF01CB5YJ.16.81.H04.1.454.CMB.1.raw
  modified_base (226)..(226): a, c, t, g, unknown or other
  misc_feature (226)..(226): n is a, c, g, or t
  modified_base (341)..(341): a, c, t, g, unknown or other
  misc_feature (341)..(341): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggcctcccaggtatcaaatgtgacatccagatgacccagtctccttccaccctgtctgcatctgtcggagacagagtcaccatcacttgccggccagtcagngtgttggtacctggttgcctggtatcagcagaaaccgaggaaacgccctaagctctgatctatgatgtctacaatataggaagtgggtccagtcaaggttcagcgcagtgatcgnggacagtattcactctcacatcagcacgcctacagcctagactgttatttgacgttactttagtacttacgacctaagtaagttaataaggttagtttaacttccgtaacgtttcggacccttagggacctaagtgtacgtataactacgaaacgtctggtagctagaccactatgttcgttacc

SEQ ID NO: 167362 - DNA, 532 bp, Homo sapiens
  misc_feature: GYAE6OF01B2E65.16.81.H04.1.454.CMB.1.raw
  modified_base (197)..(197): a, c, t, g, unknown or other
  misc_feature (197)..(197): n is a, c, g, or t
  modified_base (341)..(341): a, c, t, g, unknown or other
  misc_feature (341)..(341): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcacatcacttgccggcagtcagagtgttggtactggttggcctggtatcgagcaagaaaccgagggaaacgcccctaagctccgtgatctatgatcgtctacaatagtaggaagtcgggtaccatacgaagtcaggnggcgaggtggactcgtggacagtacttcacgttacacaccatcgacgctacgcctacacgtctagattgtatttcggacttactttagtactacgactaataggtataagtacgttattacgtaccgttcggcctaggactaagtggtagtatacgtacgaaacgtntacgtcggctacgactcgtnttcg

SEQ ID NO: 167363 - DNA, 542 bp, Homo sapiens
  misc_feature: GYAE6OF01DTG5T.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggtggcctggtatcagcagaaaccagggaaagcccctaagctcctgatctatgatgtctccaatataggaaagtgggtcccatcaaggttcagcggcagtggatctgggacagattcactctcacatcagcagcctacagcctgatgtatttgcgtacttattattgaccaactagtaataagtagtttaattctaacgtttccggacccttcggggaacctaagttggtaggtaattaacgtaccaaaacggtaacgttggtacgggtactacggtacctaacccattcgttcgttctttacccg

SEQ ID NO: 167364 - DNA, 545 bp, Homo sapiens
  misc_feature: GYAE6OF01DZOZE.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaagccccctaagctcctgatctatgatgtctcaatataggaaagtgggtcccatcaaggttcagcggcagtggatcgtgggacagaattcactctcacatcagcagcctacagcctagatgtatttgcgtatttattattgacctaactagtaattaaggtagtttaactttacctaaaccgttttcggacccgttagggaaccctaagttgtaggtaattaacgtacgaaaacgtacttggtacggcttacggaccacctattccttgttcttaccg

SEQ ID NO: 167365 - DNA, 600 bp, Homo sapiens
  misc_feature: GYAE6OF01C0O3C.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatatgacatccagatgacccagtctccttccaccctgtctgcatctgtcggagacagagtcaccatcacttgccgggccagtcagagtgttggtacctggttgcctggtatcagcagaaacagggaaacgcccctaagcctcctgatctatgatgtctccaatagtaggaaagtgggtcccatcaaggttcagcgcagtgatctggacagattcactctcaccatcagcacgcctacagtcctagtattgtattttggacgtacctttaagtttactacgacctaaacgtaagttaaacttaaggtaagttttactaccgttaaacgttttccgggaccccttagggggtaaccctaaaggttaccggttagggtaacttaacgtaaccgaaaacggttaacgttcgggtaggtaccgttcgaccttaacccctaagtttcccgttaggttccctttaaccg

SEQ ID NO: 167366 - DNA, 540 bp, Homo sapiens
  misc_feature: GYAE6OF01BNODU.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaagcccctaagctcctgatctatgatgtctccaatagtaggaaagtcggggtcccatacgtaaggttcagcggcaggtgatcgtgggaacagtaattcactctacaccatacagtcacgtcctaacgagcctgatgtattttgacgtacttattacttgaccaatagtaataagtagtttattactaacgtttcggccctagggaacctaagttggtaggtattagtacctaaacggactcggtggcttacgacacctaagtcttgtctttaccg

SEQ ID NO: 167367 - DNA, 632 bp, Homo sapiens
  misc_feature: GYAE6OF01DI9FI.16.81.H04.1.454.CMB.1.raw
  modified_base (269)..(269): a, c, t, g, unknown or other
  misc_feature (269)..(269): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtcctggtggcctggtatcgagcaagaaaccgaggaacncccctaagctcctgatctagtgtatcgtctaccaatagtaggtaaacggtcgggtacccagtacgtaaggttcaggcggcgaggtggtatcgtagggacacgtaattccgaactcctaccacctatacgacgacacgccttaacgacgtcctagtagtgttaactttggtaccgtttacttatttacgttacgtaacctaaacgttaagtaagttaaacggttaacgttttaacgtttaaccgttaaccgttttcccggtacccgttacgggtaacctaggttacggtgttaaacgtacgtaaaccgaaaccggttaagtcggtacggtctacgtaacctaccgtattccttgtccgtttacc

SEQ ID NO: 167368 - DNA, 665 bp, Homo sapiens
  misc_feature: GYAE6OF01D2WOZ.16.81.H04.1.454.CMB.1.raw
  modified_base (268)..(268): a, c, t, g, unknown or other
  misc_feature (268)..(268): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcacatcacttgccggcagtcagtagtgttcggtacctggtcgctgtatcagacaagaaaccgaggaacnccctaagcctctagatctatgatcgtactactaagtagtagggtaaacggtcgggtaccctaagtacgtaacggttcgaacggtcggacgtaggtaggacgttcggtaagggaactaacggtaactttccgaaccttaccgtaccctaacctagtaccgaacgtacccgaacgtacccctaacgtcggtacccttaggtaagttacgtttacgttttacggaccgtttaattttaacgtttacgttacgaaccctaaagttaagttaaagttaaacgttagtttaacttaccgttaaccggtttccggaccgtagggtaacctaagttcggagtaactaacgtaaccgaaagttcggtgtacggtctacggtactaaccatttccgtgttcttaccg

SEQ ID NO: 167369 - DNA, 565 bp, Homo sapiens
  misc_feature: GYAE6OF01BNBYP.16.81.H04.1.454.CMB.1.raw
  modified_base (266)..(266): a, c, t, g, unknown or other
  misc_feature (266)..(266): n is a, c, g, or t
  modified_base (385)..(385): a, c, t, g, unknown or other
  misc_feature (385)..(385): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagataacccagtctccttccaccctgtctgcatctgtcggagacagagtcaccatcacttgccggccagtcagagtgtggtacctggttgcctgtatcagcagaaaccagggaaacncccctaagctcctgatctatgatgtctaccaatagtaggaaagtgggtacccagtcgaaggttcaggcggctaggtgagtcgtagggactaagaattcactctacaccataccagcacncctacacgtcctagatgtatttgacgttatttattagttacgactaacgaagtaagtaagtaagttacttaccgtaaccgtttcggcccgttagggacctaacgtgttacggtatacgtaaccgaaacgtacgttaggtcggaccttggaccctaactacttcgtcgttcttcgtacccg

SEQ ID NO: 167370 - DNA, 618 bp, Homo sapiens
  misc_feature: GYAE6OF01CYDT4.16.81.H04.1.454.CMB.1.raw
  modified_base (259)..(259): a, c, t, g, unknown or other
  misc_feature (259)..(259): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgtggtactggtgctggtatcagcagaacaggaacnccctaagctctgatctatgtatgtacctactaatagtagggtaaagtcgggtacccagtacgtaaggttcaggtcggacgtaggtgatcgtagggaactagtacttacgactactaccacctataccgacgccaacgtccctaacgacgtccgtagtaacgttgttacgttttcgacgttacttatttactacgacctaacgtaagttaactaaggttaacgtttacttaccgttaacggttacccggacccgttagggtaaccctaagttcggtagtacttaaacgtaaccgtaaacggttacgtcggttacgtaccttacggaccctaacgttactttacgttcgtttcccttaccg

SEQ ID NO: 167371 - DNA, 599 bp, Homo sapiens
  misc_feature: GYAE6OF01DB3E5.16.81.H04.1.454.CMB.1.raw
  modified_base (575)..(575): a, c, t, g, unknown or other
  misc_feature (575)..(575): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcgccgggccagtcagagttgttggtacctggtggcctggtatcagcaagaaaccgaggaaacgcccctaagctcctgatctatgtatgtcctacctaagtagtagggtaaacggtcggggtacccaagtacgtaaggttcaggcggtacgaggtggagtcgtagggactaagtacttcactcctacaccatcgagccaacgcctacagtccgtagtactgttatttgacttaattattatcgactaatagtaactaagttagtttacttacgaaccgtttccggaccgtaggaacctagttggtacggtattaacgtaaccgtaaacggtacgttacggtacggtacttacggacccttaaccgtntttaccgtcgtttccctttacccg

SEQ ID NO: 167372 - DNA, 676 bp, Homo sapiens
  misc_feature: GYAE6OF01D85EO.16.81.H04.1.454.CMB.1.raw
  modified_base (278)..(278): a, c, t, g, unknown or other
  misc_feature (278)..(278): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcacgttcgccggccagtcagagttgttggtacctggtgcctggtatcagcaagaaaccgagggaacncccctaagctccgtgatctatgatcgtctacaatagtaggaaaggtcgggtacccagtcgaaggttcacggcggtacgaggtaggtacttcggtagggactaagtaactttccaacttcctactaccattaccgagcccaacgtccctaacgacgtcccttagtaacgtttgttacgtttttcggaaccgtttaacttttaacgtttagttaccgaaccttaaacgttaagttaaattaaagttaacgttttactttaacccgtaaccggttttcccgggaccccgttaaggggtaacccttaaggtttcggttaacgggtaattaaccggttaaaccgaaaaccgggttaacgttcgggtacgaccgttaccgtacccgtaacccgttagtttcccg

SEQ ID NO: 167373 - DNA, 630 bp, Homo sapiens
  misc_feature: GYAE6OF01AUAP1.16.81.H04.1.454.CMB.1.raw
  modified_base (391)..(391): a, c, t, g, unknown or other
  misc_feature (391)..(391): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcactggccgggccagtcagagtgttggtacctggttggcctggtatcagcagaaaccgagggaaacgcccctaagcctctgatctatgatgtctccaatagtggaaagtcggggtcccatcgaaggttcacggcggcgaggtggagtcgtgggacagtacttcactctcaccatcagcagcctacncgtcctgattgtacttttgcgtaactttattacttacgacctaaataagttaattaaaggttacgtttaatttaccgtaaaccgtttttcccgggaccccgttacgggtaaccctaaagttcgggtttaacggtaagttaacgttaacccgaaaaccgggttaaccgttagggttaccgggtaaccttccgggtaaccctaacccggtactttcccgtttaggtttcccgttttaaccc

SEQ ID NO: 167374 - DNA, 618 bp, Homo sapiens
  misc_feature: GYAE6OF01COHS0.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctcccttccaccctgtctgcatctgtcggagacagagtcaccatcacgttggcccgggccagtcaggtagttggttcggtaccttgggttcggccgttgggtatcgagtcaacggaaaccgaggggaaacgcccctaagcctcctgactctatgtatcgtcctacaatagtaggaaacggttcgggtacccagtacgtaaggtcgaggtccgacgaggtggagtcgtgggacagtacttcactctcacatcacgcacgcctaacgacgccgtagacttgtagttttcgacgttactttagtttactcgaacctaagtaagttacgttaagtacggtttattaccgtaacgtttccgggacccgttggaaacctagttggtaaggtacttaaacgtaaccgaaagtaacggtggttacggaccttagaccctaccgttattcccgttgtttccttccg

SEQ ID NO: 167375 - DNA, 665 bp, Homo sapiens
  misc_feature: GYAE6OF01EDAV9.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagtagtgtttggtacctggttcggtccgtggtatcgacgacaacgaaaccgaagggaaacgacccctaagcctccgtgactcgtatgatgtctacaatagtaggaagtcgggtacccagtcgtaacggttcgaggcggcgaggtggactcgtgggacagtattcactctacacctatcagtacacgacctacgagacctgtaattgtacgttttcgacttacgttttaattacgttacgaacctaacgtaagttaaagttaaacggttacgtttaacgtttaaccgttaaccgttttacccgggtaccccgttacgggtaaaccccttaagttacgggtaacggtaactttaaaccgtaaccgtaaaaaccgttaacggttcggttaacgggtaccttaaccggaccctaaaccgtacttttaccggttacgttcccgtttaccg

SEQ ID NO: 167376 - DNA, 616 bp, Homo sapiens
  misc_feature: GYAE6OF01EW8JP.16.81.H04.1.454.CMB.1.raw
  modified_base (298)..(298): a, c, t, g, unknown or other
  misc_feature (298)..(298): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctcctcccaccctgtctgcatctgtcggagacagagtcaccatcacttggccgggccagtcagagtgttggtacctggttcggcctggtatcagcaagaaaccgagggaaacgcccctaagctcctgactctatgntcgtctaccaatagtaggaaaggtcgggtaccagtacgaaggttcgacggcggcgaggtggatacggtgggaacaagtaacgttcacgtctaccaacctatcgagccacgacctacacgtccgtagtagttgttacttttgacgttaactttatttagtacgtaccctaaagaagttaactaaggtaagtttaacttaccgtaaccgttttccggacccgtagggaaccctagttggtaacggtattaaacgtaacgaaaaccggttagttcgggtacggtcaccggtccaaccctatttccgttagttcccttaacg

SEQ ID NO: 167377 - DNA, 776 bp, Homo sapiens
  misc_feature: GYAE6OF01BZHU2.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctccaggtatcaaatgtgacatccagatgacccagtcctcccttccaccctgtctgcatctggtcggagacagacgtcaccatcacgttcggccgggccagtcagtaggttggttcggtaccgtggttcggccgttaggtactcgagacgaaacggaaaaccgacgggaaaaccgtcccccgtaaaggccttaccgtacggaactttaccgttaagttcggaactttccggttacccttaccgaaagtttacggtaacggggtaaacggggttcccggggtaccccaaggttttacggaacgggtttacgacgggtaccgggacgttaggtacggtacgttaccggtagggggtaaccctaaggtaacgtttacctaaccgttccgtacccaaccgtaattccgaacgtccgaaccgtaccctaaacgcggtaccctgtaacttgttaagttttcggacctttaatttacgtttaagttcgaacccgttaaattacggttaaagttacgttaacgttttaacgtttaccgttaaccggtttcccggacgtttaccggaaccgttaggttaccgtaaggtacttaaacgtacgtaaaaccggtgttacggtccgtacgttacacccgttaacgttcgttcgttccgttacg

SEQ ID NO: 167378 - DNA, 581 bp, Homo sapiens
  misc_feature: GYAE6OF01C9OGI.16.81.H04.1.454.CMB.1.raw
  modified_base (193)..(193): a, c, t, g, unknown or other
  misc_feature (193)..(193): n is a, c, g, or t
  modified_base (384)..(384): a, c, t, g, unknown or other
  misc_feature (384)..(384): n is a, c, g, or t
tcagtgtactactccacgaccggtgctcgatttagtagtgtagattcgcgggggtcagactcagtcaggacacagcatggacatgagggtccccactcagctcctggggctcctgctgctctggctcccaggtatcaaatgtgacatccagatgacccagtcctccttccaccctgtcctgcatctgtcgganacagagtcacatcacttgccggcagtcagagtgttggtacctggttgcctggtatcagacaagaaaccgagggaacgcccctaagctcctgatctatgatgtctacaatagtaggtaaagtcgggtacccaagtcgaaggttcaggcggactaggtggatcgtagggaacagtacttcgactctacactancagacacgacctacgacgtctagtacgttgtacttttgacgttactttattacgttcgaactaacgtaagttaactaaggttacgtttaacttacgtaaaccgtttcggacccgttaggaacctaagttgtacggtaatacgttaacgaaacgtattggacgtaccttcggacctacgtattccttgttcctttacg

SEQ ID NO: 167379 - DNA, 592 bp, Homo sapiens
  misc_feature: GYAE6OF01BU1UN.16.81.H04.1.454.CMB.1.raw
  modified_base (191)..(191): a, c, t, g, unknown or other
  misc_feature (191)..(191): n is a, c, g, or t
  modified_base (273)..(273): a, c, t, g, unknown or other
  misc_feature (273)..(273): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccggccagtcagagtgttggtacctgggttggccttggtatcagcaagaaaccaggggaaacncccctaagcctcctgatctatgatgtctacaatatggaaaggtcgggtacccatcgaaggttcaggcggacaggtggatcgtggacagtacttcactctaccaccatcagcacgaccctacacgtctagtagttagtattttacggcgttaaccttttagtttacttacgaccgtaaacttaggtaaattaagtagttttacttaccgtaacgttttcccggccgttagggaaccctagttacggtagtaacttacgtaacaaaaccggtacgttgggtacgtctacgcctaacctagttcccttgtttcccttacccg

SEQ ID NO: 167380 - DNA, 550 bp, Homo sapiens
  misc_feature: GYAE6OF01EUINY.16.81.H04.1.454.CMB.1.raw
  modified_base (360)..(360): a, c, t, g, unknown or other
  misc_feature (360)..(360): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggcctggtatcagcagaaaccagggaaacgcccctaagctcctgactctatgatgtctaccaatatagggaaaggtcgggtcccatcaaggttcagcggacaggtggatcgtaggganagaacttcactctcacatcagaccaacctanacgcctagactgtatttgacgttatttattacttanacctaanagtaataagattaacttctaacgtttcggaccctagggaacctaagtcggtagtaaataacgtacgtaaacgtaattggtcggacttgacctaccacttctacgttccttcgtacg

SEQ ID NO: 167381 - DNA, 654 bp, Homo sapiens
  misc_feature: GYAE6OF01ELB5A.16.81.H04.1.454.CMB.1.raw
  modified_base (287)..(287): a, c, t, g, unknown or other
  misc_feature (287)..(287): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatcgacccagtctccttccaccctgtctgcatcgtggtcggagacagacgtccacatcacgttcggccggcagtcagagtgttcggtaccgtgggtcgccttggtactcgagacaacggaaaccgaagggaaaccnccccgtaagccttccgtagacttcgtatgtacttcgtacctaccaagttaggtaacgggtaaacggtccgggtaccctaagttacggtaaaggttccgaggcggacgtaggtcggatcggacgggtaacaagtaacttaccacgttccaccgaacctagtaccgacgaccgtaccgaccctagacgtacctgaacgttgttactttgaacttatttacgttactacgaactaacgttagtaattaagtactttactaccgttaaccgttcggacccgtaaggtactagttggtataaactacgtaaccgtaaacggtgttcggtcgtacgtacgcctactactccgttaacttccgttcgtaacccg

SEQ ID NO: 167382 - DNA, 567 bp, Homo sapiens
  misc_feature: GYAE6OF01A7P7R.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaacgcccctaagctcctgatctatgatgtctaccaatataggaagtgggtccatcgaaggttcagcgcgagtggatcgtggacagaatcactctacacatcagcacgcctacacgtcctagacttgtacgttttgaccgttactttagttacttcgacctaacgtaagtaattaagtagtttaacttaccttaaccgtttcggacccgtagggaacctaaggttcgtagggtattaacgtaccgtaaacggtacttaggtacggtccgtaccgtactaccctagttcttcggttcctttaccg

SEQ ID NO: 167383 - DNA, 554 bp, Homo sapiens
  misc_feature: GYAE6OF01DXB3M.16.81.H04.1.454.CMB.1.raw
  modified_base (197)..(197): a, c, t, g, unknown or other
  misc_feature (197)..(197): n is a, c, g, or t
  modified_base (265)..(265): a, c, t, g, unknown or other
  misc_feature (265)..(265): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgctatctgtcggagacagngtccaccatcactcgccggccagtcagagtgtgtacctggtgctggtatcagcaagaaccaggaaacnccctaagctcctgactctatgatgtactacctaatagtagggaagtcggggtccctaagtactaaggtcgagcggcgtagtaggatcgtaggacagtacttcgactctacaactatacacgtcaacgcctacacgctgtaacttgtatttgacgttaatttattattcgactaatagtaataagttagttacttacgtaccgtttccggaccgtacggtaactaagtgtagtataacgtaacgaaacgtacgtggtacgctacggtccacttagtcttcgtcttacccg

SEQ ID NO: 167384 - DNA, 568 bp, Homo sapiens
  misc_feature: GYAE6OF01D3GIA.16.81.H04.1.454.CMB.1.raw
  modified_base (271)..(271): a, c, t, g, unknown or other
  misc_feature (271)..(271): n is a, c, g, or t
tcagtgtactactccacgaccggtgctcgattttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttggcctggtatcagcaagaaaccgagggaaacncccctaagctccgtgatctatgatgtctacaatagtaggaagtcgggtaccatcgaaggtcaggcgacgagtggatcgagggacagtatcgactcacactatcagcacgcctagagcctagtatgtatttcgcgtaatttattatcgactaaacgtgttaaacgtaagtacgttaactttaccgtaacggttttcccgaccggtacgggtaacctaacgttggtaacgtacttaacgtaacgaaaacgtacgttggtacggactcgacctaacccgtagttccttcgttccttaccg

SEQ ID NO: 167385 - DNA, 768 bp, Homo sapiens
  misc_feature: GYAE6OF01BLACL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttggcctggtataagcagaaaccgagggaacgccctaagctcctgatctatgatgtacctccaatagtagggaaaaggttcggggtacccctagttaccgtaaagggtttccaacggcggtacgaacgggttagggaagttccgtaggggtaaacctaaggtaaatttcccgaaacgtttcctaccgaaaccctaacgttaccgaacgacctaacggaccccgttaaccgacggtaccccttaggtaactttagttaagttttttggtaacgttaaccttttaagtttaacgttttacggaacccttaaaccgttaagttaaagttaaacgggtttaacgttttaaacgtttaacccgtaaacccgttttttaacccgggtacccccgtttaacgggggtaaaccccttaaggttaccggttaacggtaacttaaacgttaaccgaaaaaccggttacgttacgggttacggtacccgttaacggccctaaaccgtaacttaccgtttacgttcccgtttaccgttaacccg

SEQ ID NO: 167386 - DNA, 637 bp, Homo sapiens
  misc_feature: GYAE6OF01C9IQL.16.81.H04.1.454.CMB.1.raw
  modified_base (192)..(192): a, c, t, g, unknown or other
  misc_feature (192)..(192): n is a, c, g, or t
  modified_base (280)..(280): a, c, t, g, unknown or other
  misc_feature (280)..(280): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgctatctgtcgganacagagtcaccatcacgttcgccggcagtcagtagtgttcggtaccttggttggccgtggtactcgagcaagaaaccgaagggaaacncccctaagcctcctagatctatgatcgtctacaatagtaggaaggtcgggtaccagtacgaaggtcagcgcgagtggatcgagggacagtattcactctacacactcacgcaacgtccaactgtccgtagtacttaggtcttttacggaccttaactttagtttacgttacgaaccttaacgtaagtttaacgtaaaggtaacgttttaacgtttaccgttaacccggttttcccgggtaaccccgttggggtaaacccttaaggttcggttaaggtaactaacgttaaaccgtaaaacgacgttcgggtacggtccttacggacccttaaacctgtttcctaggttccctttaccg

SEQ ID NO: 167387 - DNA, 615 bp, Homo sapiens
  misc_feature: GYAE6OF01D66AO.16.81.H04.1.454.CMB.1.raw
  modified_base (270)..(270): a, c, t, g, unknown or other
  misc_feature (270)..(270): n is a, c, g, or t
  modified_base (460)..(460): a, c, t, g, unknown or other
  misc_feature (460)..(460): n is a, c, g, or t
  modified_base (594)..(594): a, c, t, g, unknown or other
  misc_feature (594)..(594): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccaccctgtctgcatctgtcggagacagacgtcaccatcacttcgccggcagtcagtagtgttggtacctggttgcctggtatcagcagaaacaggaaacnccctaagctcctgtatctatgatgtctacaatagtaggaaagtcggggtaccaagtcgtaaggttcaggcggactaggtggagtcgagggacaagtaacttcactcctacaacctatacgaacgtccaacgtacctacgacgtcctagtagttgttattttagacttaactttatttacttacacctaanaagtttaataaaggttaagttttaacttaccgttaaccgtttcccgggacccttacggggtaacctaagttcggttaacggtaacttaactaacgtaaaaccgtacgttcgggtacggctacgccttaaaccgntttccgtgtttcccgttaacc

SEQ ID NO: 167388 - DNA, 698 bp, Homo sapiens
  misc_feature: GYAE6OF01DSOPH.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatcctgtcggagacagagtcaccatcacttgccgggccagtcagagtgttggtacctgggtggcctggtatcagcaagaaaccagggaaacgcccctaagctcctagatctatgatgtacctctaatagtaggaaaggtcgggtaccctaagtacgtaacggttcacggcggacgtaaggtggacttacgtaggggaactaaggtacttaccgactacctacaaccgtactacgaacgccgtaacggtcccttaacgacggtcctaagtaagttggttaacttttcggaccgtttaacttttagtttaacttacgtaacccctaaagtagttaaacttaaggtagtttaacgtttacccgtaaaccgttttccgggacccgttaggggtaaccccttaaaggtttcggaaagggttaacttaaaccggtaaacccgtaaaaaccgggttaacgttgggtaccgggtacctaccggtaccctaaacccgttagttttcccgttcgttccgtttaacccg

SEQ ID NO: 167389 - DNA, 790 bp, Homo sapiens
  misc_feature: GYAE6OF01ALW1N.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctcccttccaccctgtctgcatctgtcggagacagacgtccaccatccacgttcggcccgggccagtccaggtagttcggttacgggtaccgttgggttcggccgttgggtactcgaacggacgaaacggaaaaccggaacggggaaaccgtacccccgtaaaggtccccttaccgttaggtaactttaccgttaagttacggtaacgtttccggttacccttaaccgtaaaagttaacgggttaacggggtaaaacggggttccgggggttaacccctaaggtttaaccggtaaacggtttccgaacggccgggtacgtagggttacgggtacgtttcgggaacggggtaactaacggttaaacctttaccgtacccttacctacccgaacctaacgtaccgaacgacctaccggtaccctacgaccgtccgttagtacttaggttacttttcggactttaactttagttacgttacgaacgtaaactaaggttaacttaaaggttacgtttaaccttaccgttaaccgtttcccggaccggttaacggaaccttaagtcgtagtaaccttacgtaacgaacggttacgtcggtcgtactacgacctacttacgtcttgttccttcg

SEQ ID NO: 167390 - DNA, 546 bp, Homo sapiens
  misc_feature: GYAE6OF01BLIEZ.16.81.H04.1.454.CMB.1.raw
  modified_base (363)..(363): a, c, t, g, unknown or other
  misc_feature (363)..(363): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggcctggtatcagcagaaaccagggaaacgcccctaagcctcctgatctatgatgtctccaatataggaaagtgggtccatcaaggttcagcggcagtggatcgtgggacagacttcactcncacatcagcagcctacgcgcctgatgtatttgcgtactttattattcgacctaagtagtaataagtagtttacttactaaccgttttcggacccgttagggacctaaggttgtacgtattaacgtaccgtaaaggtactggttacgcgttacgacctaaccgtatttcccgtgttcctttccg

SEQ ID NO: 167391 - DNA, 629 bp, Homo sapiens
  misc_feature: GYAE6OF01C0NKX.16.81.H04.1.454.CMB.1.raw
  modified_base (450)..(450): a, c, t, g, unknown or other
  misc_feature (450)..(450): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
tcagtgtactactccacgaccggtgctcgatttagtagtgtagattcgcgggggtcgagactcagtcaggacacagcatggacatgagggtccccgctcagctcctggggctcctgctgctctggctcccaggtatcaaatgtgacatccagatgacccatctccttccacctgtctgcctatctgtcggagacagactcacatcacttgccggcagtcagtagtgttacggtaccgttgggttcgccgttaggtactcgaacggtaacaaacggaaaaccgaacggggaaaccaccccgtaaagtcctaccgtagtaactctaagtgtagttcgtacctactaataggtaaggtaaacggtcgggtacccagtacgtaaggttcgaggaccgagtaaggtcgtagttacgacgggaactaagtactttacactttacacacatacgacnccgtactaccgtacgactctagattgtactttnacgttaacttnttacgtcaactaatagttaataaggttattaacgttctaacgttcgtaaccgtaggtaactaggttgtacggtatagttaaccgaaacgtagttcgaacggttccacgtaccgaccttattaccttgtccttaac

SEQ ID NO: 167392 - DNA, 561 bp, Homo sapiens
  misc_feature: GYAE6OF01DDWUF.16.81.H04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtcctccttccaccctgtctgcactctggtcggagacagngtccaccatcacgttgccggccagtcagngtgttggtactggtggcctggtactcagacagaaccgaaggaacgccctaagcctcctagtactctatgatgtctacaatagtaggaaaggtcgggtaccatacgaaggtcagcggactaggtggatcgtagacagtattcactctactacatacacacacgtctaacagtccgatacgtgtatttcgactttacttaagttacttcggaacctaataacgttaagtaagtacgtttaattaccgtaacgtttccggtacctagggaccctagtcgtaggaacttagtaactaaacgtacgtggtacgactcacctaccgtattccg

SEQ ID NO: 167393 - DNA, 623 bp, Homo sapiens
  misc_feature: GYAE6OF01ERLXL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctcccttccaccctgtctgcatctgtcggagacagagtcaccatcacttgccggcagtcagagtgttggtacctggttggcctggtatcagcagaaaccagggaaacgcccctaagctctgatctatgatgtctaccaatagtaggaagtcgggtacccagtacgaaggttcaggcggacgagtggtagtcgtaggacagtacttcactctaccactactcacgacacgacctaacgacgtaccgtagtacgttagttagttttcggaccgttactttactttagttaccgtaacctaaacgtaacgttaagttaaacgttaagttttaacttaaccgtttaaccgtttacccggtacccgtaacgggtaaccgtaagttacggtacggtaattaacgtaaaccgtaaacgtaacgttcggtacggtactacgacctaacctagttcgttcgttcgttaccg

SEQ ID NO: 167394 - DNA, 660 bp, Homo sapiens
  misc_feature: GYAE6OF01AY51H.16.81.H04.1.454.CMB.1.raw
  modified_base (191)..(191): a, c, t, g, unknown or other
  misc_feature (191)..(191): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcacatcacttcggccggcagtcaggtagttggtttcggtacgttgggttcggccgttggtatccgagacgaacggaaaaccgaacgggaaaccgacccctaagccttacgtagactcgtaagtgtaatcgtacctacaagttagtagggtaaaggtccgggtacctagttacgtaaggttccgaacggccggagtagggtacgagtaccggtagggtaactaacgtaacttccgaaccttaccgtaccaaccgtaactaccgtaacggacctaacggtaccctaagaccgtccgtagtatttacgttaagtttcggaactttactttaattagttaccgaactaaagtaagtaagttaaagtacgtttacttaccgtaactttccggaccgtacgaacgtaatggtagaatactaacgtaacgtatcgtacgctacgacctaacttatcgttacgtctaacg

SEQ ID NO: 167395 - DNA, 604 bp, Homo sapiens
  misc_feature: GYAE6OF01DQBFY.16.81.H04.1.454.CMB.1.raw
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (406)..(406): a, c, t, g, unknown or other
  misc_feature (406)..(406): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagacgtcaccatccacttcggccgggaccagtccaggagttggtttcggtacctggttggccttggtatcgagacaagaaaccgagggaaacgcccctaagctcctgatctatgatgtctcaatntaggaagtgggtccatcaagtcagcgcgagtgtgngtggacgagacgtactacgtctaccacgtactactacgacacgaccgactacncgtacgtagtagttagtttacgttacgtactttattacgtttacgtactaactaacgtaagtaacgttaagttattacgttaccttaccgggttccgtaccggtaacgtaacttaggtaggttaagtaacgttaacgaaacggttaacgtaggtacggtcgtacgtacccgtaactaccgtacgttgttccgttaccc

SEQ ID NO: 167396 - DNA, 586 bp, Homo sapiens
  misc_feature: GYAE6OF01B6FUR.16.81.H04.1.454.CMB.1.raw
  modified_base (267)..(267): a, c, t, g, unknown or other
  misc_feature (267)..(267): n is a, c, g, or t
  modified_base (426)..(426): a, c, t, g, unknown or other
  misc_feature (426)..(426): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgaccagtctccttccacctgtctgcatctgtcgagacagagtcacatcacgtgccggcagtcagtacgtgttggtacgtggtgccgtgtatcagacaagaaaccgaggaaccncctagctctgatcgtactgatcgtactacctaagtacgtagggtaaaggtcgggtaccaataccgtaaggtacacggcggcgaaggtgactcggtagggaactaagtacttcacttcacaaccatacgacgacacgtctaacgacgtctagtatagttnttagtacgttattattagtaccgataacgtaagtaataagttattaacgttaccgtaaacgtttccggaccgttacgggtaactaacgttacgtagtaactaacgtaacgaaacgtacgtaggtacgactacgtactaacgtatcgttacgttcttaccg

SEQ ID NO: 167397 - DNA, 738 bp, Homo sapiens
  misc_feature: GYAE6OF01B6U5D.16.81.H04.1.454.CMB.1.raw
  modified_base (271)..(271): a, c, t, g, unknown or other
  misc_feature (271)..(271): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcactcggccggccagtcagtgtgtcggtacgtggttgctggtatcgagcaagaaccgagggaaccncccctaagcctcgtagatctatgatcgtactactaatagtagggtaaaggtcgggtaccctagtaccgaaggttcgacggcggtacgtaggtcggtaactcggtacgggaactaagtaacgttactaccttaccgtacctaaccgtacgtccgaacggtacccaaccgtaccccgtaacgtaccggtcccttaggtactttacggttaacgttttccgggaacctttaaaccgttttaagtttaccttaccggtaaccctaaacgttaacggtttaaaagtaaaggtttacgttttaacgttacccgttaaaacccggtttttccgggaaccccgttagggtaaacccttaaggttacgggttaacggtaaacttaaaccggttaaccggtaaaacggttacgttacgggtaccggtacttacccgtaaccgtacccgttaatttcccgttggttccctttaacccg

SEQ ID NO: 167398 - DNA, 666 bp, Homo sapiens
  misc_feature: GYAE6OF01BM36M.16.81.H04.1.454.CMB.1.raw
tcagtgtactactccacgaccggtgctcgatttagtagtgtagattcgcgggggtcagactcagtcaggacacagcatggacatgagggtccccgctcagctccgtggggctcctgctgctctggctcccaggtatcaatgtgacatccagatcgaccctagtctccttccacctgtctgcatcgtgtcggagacagacgtcactatcacgtcgccggcagtcagtagtgttcggtaccgtggtggccttaggtatccgagacgaagaaaccgagggaaacctccccgtaagctacctgattcgtatgacttcgtacctacgtaatacggtaggaacggttccgggtacctataccggaacggtcgaacggcggtactagggtcgtagtcgggtaacggtactaaggttaacttacgaccgttactacgtacctacgtacgaacggcgtaacgtaccccgtaagtaccggtaccgtgtaacctttgtttacgttcgttacgttacctttaagttacgtaccgtaagttaaccgtagtaaacgtaaggtttactaaccgtttaccgttaaccgttacggtcccgtacggtaactagtacggtagtacgtaagaacgtacgtacggttacgcggtacctaggtacccacgttattcgtgttccctacg

SEQ ID NO: 167399 - DNA, 678 bp, Homo sapiens
  misc_feature: GYAE6OF01AS8IZ.16.81.H04.1.454.CMB.1.raw
  modified_base (663)..(663): a, c, t, g, unknown or other
  misc_feature (663)..(663): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatccacttgccgggccagtcagagtgttggtacctggttgcctggtatcagcagaaaccagacgaaacgcccctaagcctcctgatctatgatcgtcctacctaattaacgtagggaaaaggtcggggttaccccagttaccgtaagggtttcaaggtcggacgacggtggaattcggtggggaaccgtaaggtaaactttcaccgttacctaccaacccgtattccgagccaacggtccctaacgaacgtcctagtattacggttattttcggactttaacgtttattagttacgtaaccctaaacgttaagtaattaaagggtaactttaacgtttaaccgttaaaccgttttccgggaccccgttaaggggacccttaaggttacggttaaggtaactaacgttaaccgtaaaaccggtaacgttacggtacgggtacttacggtacctaaacccgtnttccgttgtttaccc

SEQ ID NO: 167400 - DNA, 724 bp, Homo sapiens
  misc_feature: GYAE6OF01BEDFL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcacatcacttggccggccagtcagagtgttggtacctggtcggcctggtatcgagacaacgaaaccgaagggaaacgaccccgtaagctccgtgactctatgtatcgtacctacctaagtagtagggtaaaggtccggggtaccctaagttacgtaaacggttccgaacggtcgggtacgtaaggttacggacgttacggtaacgggaactaaggttaaacctttaccctaacttacccgttaccaacccgtaactccaacggacccgtaacgtaccccgtaacgacgtacccgttagtaacgttaggtttaacgttttacggaccgtttaactttagtttacgttaacgtaaccctaaagttaacgttaaagttaacgttacgtttaacttaacccgttaccgtttacccggtaccgtacgggtaacctaaggttacgtaggtaaacttacgtaaccgtaaacgtacggttcggtacggtacctacgtacctaacctagtttacccgttcgtttcctttacccg

SEQ ID NO: 167401 - DNA, 588 bp, Homo sapiens
  misc_feature: GYAE6OF01EHPKK.16.81.H04.1.454.CMB.1.raw
  modified_base (271)..(271): a, c, t, g, unknown or other
  misc_feature (271)..(271): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttcgcctggtatcagcaagaaaccagggaaacncccctaagctcctgatctatgtatgtctaccaatagtaggaaagtgggtcccatcgaaggttcagcggctaggtggatcgtagggacagtaacttcactctacacatcgacgcacgccttaacgcgtacctaggtattgttagttttcgacttactttattacgttacgaccctaaacgtaagttaataacggttaacgttttacttaccgttaaccgtttccggacccgtagggtaaccctaagttggtacgtaattactaacgtaaaccgtagttcggtagtcctacgtacctacctagtttctacgtcttaccg

SEQ ID NO: 167402 - DNA, 735 bp, Homo sapiens
  misc_feature: GYAE6OF01EJQ83.16.81.H04.1.454.CMB.1.raw
  modified_base (239)..(239): a, c, t, g, unknown or other
  misc_feature (239)..(239): n is a, c, g, or t
  modified_base (299)..(299): a, c, t, g, unknown or other
  misc_feature (299)..(299): n is a, c, g, or t
tcagtgtactactccacgaccggtgctcgatttagtagtgtagattcgcggggggagtcagactcagtcaggacacagcatggacatgagggtcccccgctcagctccgtggggctcctgctgctctggcctcccaggtatacaaatgtgacatccagatcgacccatcctcccttccaccctgtctgcatctggtcggagacagatccaccatctacgttcggccgggccagtcaggngttggttcggtaccgtgggttcggcctggtatcaggacaaggaaaaccgacggggaaacncccctaagcctcctgtactctaatgatctcctaaccgtaattagtaagggtaaacgggttccggggtacccaacttacggtaaggttcgaggtcgggacgtaaggttggacgtggtacggggaactagtaacttcaacttccaccacctactacgaccgacaccggaccctacgacgtaccgttagtagtttacggtttattttaccggtaccgtttaaactttttactttaacgttaccgtaacccaaaacgtttaagttaaagttaaacggttaactttttaaccgttaaccctttaaccggttttccccggggaccgttaacgggtaacctaaggttcgggaagttaacggttaaactaaccgtaaacggtaacgttcgggttacgggtaccttacgggacccttaacccgttacgtttccgttacgtttccc

SEQ ID NO: 167403 - DNA, 765 bp, Homo sapiens
  misc_feature: GYAE6OF01A418T.16.81.H04.1.454.CMB.1.raw
tcagtgtactactccacgaccggtgctcgatttagtagtgtagattcgcgggggtcagacgtcagtcaggacacagcatggacatgagggtccccgctcagctcctggggctcctgctgctctggctcccaggtatcaaatgtgacatccagatgacccagtctccttccacctgtcctgcatctgtcggagacagagtcaccatcacttgccggcagtcagagtgtggtacctggttgcctggtatcagcaagaaacaggaaacgccctaagctcctagatctatgatcgtctaccaatacgtagggaaacggtcggggtaccccagtacgtaaaggttcgaacggtcggacgaggtaggacgtcggtacgggaacagtaaactttcctaacctcctactaacctaacttcgaacgtaccaacggtacccttaaccgaacggtacccttaagggtaacttacgggtttaacgtttttcggtaaccggttaaacctttttaaacgtttaacgttttaacgaaccccccgttaaaacgttaaaggtttaaacttaaaacgggttaacggtttttaaaaccttacccgttaaaaaccggtttttttaccccggggaaccccccggtttaaggggggtaaaccccccttaaaagggttaaccgggttaagggttaaaacgttaaactaaccgtaaaacccggtaaacgtggttaaccgggtaccgtacgtacccgaaccttaaccttcgttaccgttacgtttacccg

SEQ ID NO: 167404 - DNA, 745 bp, Homo sapiens
  misc_feature: GYAE6OF01A2POU.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttggcctggtatcagcagaaaccaggggaaacgccctaagctcctgatctatgatgtctacctaatagtaggaaggtcggggtacccagtcgtaaacggtttcgaacggtcgggactaaggtcggtacttcggtaggggaacaagtaaacgtttccaacgttccttaccacccgtacttaccgaagcccgtacggtaccccttaaccgaggtccccgttaggtaacgtttacggttaattttttcggaaccggtttaacctttttaagtttaaccttttacggacccgtaaacttaaggtttaaacgttaaagttaacggttttaaacttttaccgtttaaacccggttttcccgggttacccggttaccggggtaacccgttaacgtttcgggttacgggtaaaccttaacgtttaaccccgtaaaaacgggtaacctttcgggttacgggtaccgttacggtaacccttaacccgtaaccgtttccgttccgtttccgtttaacccg

SEQ ID NO: 167405 - DNA, 692 bp, Homo sapiens
  misc_feature: GYAE6OF01CRHG1.16.81.H04.1.454.CMB.1.raw
  modified_base (148)..(148): a, c, t, g, unknown or other
  misc_feature (148)..(148): n is a, c, g, or t
  modified_base (281)..(281): a, c, t, g, unknown or other
  misc_feature (281)..(281): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgngacatccagatcgacccagtctcccttccaccctgtctgcatctgtcggagacagatcaccatcacgtgccggcagtcagtagtgttcgtaccgtggttcgctggtatcgagacaagaaaccgagggaaaccnccctaagcctacctagacttctatacgtatccgtactaacgtaagtacgtaagggaaacggttccgggtaccagtacgtaaggttcgaacggcggtactaaggtcggtaacgttaccgggagggaactaaaggtaacctttaccgaacttacctaccaacctataccgaacgaccacgtacctaacacggtacctaggtacgtagtttaccgtttaggaacctttaacgtttattaacgtacgtaaccctaaagtaagttaaacgttaaggttaacgtttaactttaacccgttaaccggtttaccccgggacccgttaaacgggaacccttaaggtagggtaaccgtaattaaaccgtaccgtaaaaccggttagtcggtacggacttaccggactaaccgtgtttaccg

SEQ ID NO: 167406 - DNA, 670 bp, Homo sapiens
  misc_feature: GYAE6OF01CTGHM.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatcgtggtcggagacagacgtcaccatcacttcgccgggccagtcaggtagtgttggtaccgtggttcggccgttaggtactcgaagacgaagaaaccgagggaaacgccccgtaagcctcctgatctagtgtatcgtacctacaagttaagtaggtaaacgtcggggtacccaagtaccgaaggttcgacggtcggacgtaaggttcggacgttacggtacgggaactaaggtaaacttcctaaccttacctacctaaccgtaacgtaccgacgtaaccaccgtaccctaacgacgtcctaaggtacttcgttaacgttttcggaccttaacgttttaactttacgtacgtaacctaaacgtaagttaacttaaagttaacgtttacttaccgtaaccgtttccggaccgtacggtaactaagtggtacgtaataacgtactaaacggtcgtaggtacgcctacggacctactacgttgtccgttac

SEQ ID NO: 167407 - DNA, 566 bp, Homo sapiens
  misc_feature: GYAE6OF01EHZAT.16.81.H04.1.454.CMB.1.raw
  modified_base (269)..(269): a, c, t, g, unknown or other
  misc_feature (269)..(269): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggctggtatcagcagaaaccagggaacnccctaagctcctgatctatgatcgtctacaatataggaaagtcgggtccatacgaagtcagcggnaggtgatcgngggacagtatcactctcacatcancagctacagtctgatgtattttgacgtacttttattatacgacctaactagtaacgttaaagtaggttttaacttacctaaccgttttccgggacccgttacgggaaacctaagttcggttaggaacttagttaaccgaaacgtaacggtggttacggacgtcgaacccgtaccgtaattccgttcgttccttaaccg

SEQ ID NO: 167408 - DNA, 612 bp, Homo sapiens
  misc_feature: GYAE6OF01CTMZ9.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatcgtgacatccagatgacccagtctccttccaccctgtctgtctatctggtcggagacagacgtcaccatcgacttgccggccagtcagagttgtggtacctggtgcctggtatcagtccagaaaccagggtaaacgcccctaaagctcctagactactatcgattgtactccaatacgtaggaaaacggtcggggtaccctagtcaaaggttcaggccggtctaggtggactcgttgggactaaggaactttcaaccgttcttccaactattacaagcaacggcttaacgagtacctgaattcggttatttcgactactttattagttcgactaactagttaactaagtagttattcgtaactttcggaccctagggacctaaagttcggtagtaacgttaataccgaaaactacggtttcggtacggtccttacggaccctaaccgtagtcccttaggttcccctttaccg

SEQ ID NO: 167409 - DNA, 777 bp, Homo sapiens
  misc_feature: GYAE6OF01DWRXN.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccctttccacccttgtctgcatcgtgtcggagacagagtcaccatccacgttcggcccgggccagtcaggtaggttggttcggtaccttgggttcggtccgttggtatacgaagaccgaaacggaaaccggaagggaaaccgaccccctaagtcctccgtagtacttacgtagtgtattcgtacctactaagtaagtagggtaaacggttcgggtacccaagttacggtaacggttcgacggacggacgtaggtaggtacgtcgggtaggaactaacggtaactttacctacgttacctacctaacctacgtaccgaacgtaccgaaccgtaccctaacacggtacccgtagtacttagtttacgtttacgttaccgttaacttttaacgtttaacgttacgtaaccgtaacgtaaggtttaacgtttaaaacgttacgttttaacgtttaacccgttaaccggttttacccgggtaacccgttacggggtaaacccttaggttacgggtaacgttaaccgttaaacgttaaccgtaaaaccggttacggttacgggtacggttaccgtacggtaaccctaaccgttaacttcgtttaccgttcgtttacccg

SEQ ID NO: 167410 - DNA, 536 bp, Homo sapiens
  misc_feature: GYAE6OF01ELPBU.16.81.H04.1.454.CMB.1.raw
  modified_base (266)..(266): a, c, t, g, unknown or other
  misc_feature (266)..(266): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttgcctggtatcagcagaaaccagggaacncccctaagctcctgatctatgatgtctacaatagtaggaagtcgggtacccagtcaaggttcaggcgnagtgatcgtgganagtacttcactctacacatcagcacgtcctacacgcctagtatgtatttcgcttactttattactcgacctaagtagtaattaagtagttacttaccgttaaccgtttccggaccgttagggacctaagtgtagtaactactacgaaacgtacgtggtacgtctacgtccaacgtattctgttcttacc

SEQ ID NO: 167411 - DNA, 786 bp, Homo sapiens
  misc_feature: GYAE6OF01C9KZU.16.81.H04.1.454.CMB.1.raw
  modified_base (271)..(271): a, c, t, g, unknown or other
  misc_feature (271)..(271): n is a, c, g, or t
tcagtgtactactccacgaccggtgctcgatttagtagtgtagattcgcgggggtcagactcagtcaggacacagcatggacatggagggtccccgctcagctcctggggctcctgctgctctggctccaggtatcaaatgtgacatccagatcgacccagtcctccttccaccctgtctgctatcgtcgtacggagacgagacgtccacctatctaccgttcggccgggctagtcgagtagttgttcggtactgggttcgccgtggtacncgagacaacggaaaccgaaggggaaacctaccccgtaagtcctaccgtagtaacttctaagtaggtacttcgtacctaacctaaagttaggtaacgggtaaacgggtcgggtaccctaagtaccgtaaaggtcgaggccggtagtaaggtggtacgtacggtagggaacctaagtaaaccttcctaacgttacctacctaaccgtattaccgaacgaccgtaaccgtaccctaacgtaccggtacctaagtacgtttggttacgttttacggaccgtttaacttttaacgtttaacgttacccgaacccttaaacggttaattaaacgtttaaacggttacttttaaacgtttacccggttaaaccggttttcccgggtaaacccggttacgggttaaacctaaggttacgggttaaacggtaatttaaaccggtaacccgttaaaacggttacggttcgggtaacgccgttaaaccggccttaaccgtattacccggtttcgtactttaccccg

SEQ ID NO: 167412 - DNA, 555 bp, Homo sapiens
  misc_feature: GYAE6OF01BMASV.16.81.H04.1.454.CMB.1.raw
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (550)..(550): a, c, t, g, unknown or other
  misc_feature (550)..(550): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttggccgggccactcagagtgttagcaggtggtgcctggtatcagcaagaaccgagggaacggccctagaactcctagactctatcgatcgccagctaagtttaggaaaggtcgggtacccagtccaaagtnttcgagcggacagtggactcgngggactagtacgtcactcacaccatcagcacgccctgcacgtcagtagttgtactttcgaacctaactttatagttcgaactaataagtattaagttacgttagtccggtggtaacgtccgggacgtacgggaacggtagggtcggaactgtaaaccgaacgtacgtcggtcgactacgactacccgtnttacg

SEQ ID NO: 167413 - DNA, 577 bp, Homo sapiens
  misc_feature: GYAE6OF01EPBRJ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttggcctggtatcagcaagaaccgagggaaacgcccctaagcctcctgatctatgatgtctacaatagtaggaaagtcggggtacctagtacgaacggttcgaggcggcgtagtggacgtcgtagggacagtactcactctacacatcagcacgcctagcgctgattgtatttgacgttactttattacttacgacctaagtagttaagttaagtagtttactttaccgtaaccgtttccggtacccgtacgggtaacctaagtcggtaggtaacttaacgtaccgtaaacggtacgttggtacggtactacgacctacgtattccgttgttccttacccg

SEQ ID NO: 167414 - DNA, 564 bp, Homo sapiens
  misc_feature: GYAE6OF01DGBIN.16.81.H04.1.454.CMB.1.raw
  modified_base (269)..(269): a, c, t, g, unknown or other
  misc_feature (269)..(269): n is a, c, g, or t
tcagtgtactactccacgaccggtgctcgatttagtagtgtagattcgcgggggtcagactcagtcaggacacagcatggacatgagggtccccgcttcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaancccctaagctcctgatctatgatgtctcaatagtaggaaagtgggtacccatcaaggttcagcggcagtggatcgtgggacagtaattcactctcacatcagcagcctacagcctagattgtattttgacgttactttattacttacgaccctaaagtagttaattaagttaagttttactttacctaaccgttttccgggacccgttacggggaaccctaagttggtaggtaataacgtacgaaaacggtacgttgggtacggtctacggacctaaccattcttgttccttacc

SEQ ID NO: 167415 - DNA, 723 bp, Homo sapiens
  misc_feature: GYAE6OF01BPG86.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagacgtcacatcgacttgccggcagtcagagtgttggtaccgtggttgctggtatcgagacaagaaaccgaagggaacaccctaagctacctgatctatcgatcgtctaccaagtaagtagggaaacggtcgggtaccctagtacgtaaggttcgaaggcggacgtaggtaggacgtacggtagggactaaggtaaacttccgaccttacgtaccaaccgtattaccgagtaccaacgtaccctaacgaacgtccgttgtaattcggttaacgtttttcgggactttaacgttttaatttacgtttaccggaaccttaaacgtaagtttaaacgttaaacggtttacgttttaaacgtttaacccgttaaacccggttttcccgggaccccggttaacggggtaaccctaaagggtttacggtaacggtaactttaaacggtaaaccgtaaacccgggttaggttacggtaacgggtccgttacgtaccccggtaaccttaagtttcccttacggtttccctttaaccg

SEQ ID NO: 167416 - DNA, 703 bp, Homo sapiens
  misc_feature: GYAE6OF01C3RBM.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgaccagtctccttccacctgtctgctatcgtgtcggagacagacgtcaccatcacgttggccggcagtcaagtcgtgttggtaccgtggttaggcctggatcagacagaaaccgaaggaaacgcccctaaagctcctagatacgtatggtatgactccaaagtagtagggtaaaacggtcggggtacccctaattaccgaagggtttacacggcgggactaaggttaggaacttcgtaggggtaccaggaaacgttttacacttcctactaacccgagtacaacggtccaaccggtaccctaacgtacggtaccttaggaaactaggttaacgttttcggaacccggttaccgtttaatttaactttacggacccgtaaataacgttaaagtaagtaacggttttaactttaaccgtaacgtttttaccgggacccgttacggggaacctaaaacgtgggtaccgggtaattacgtaaaccgtaaaacgtaaacgtacgttacgggtatacgggttccctaaactactttacctaggtttccttaacccg

SEQ ID NO: 167417 - DNA, 692 bp, Homo sapiens
  misc_feature: GYAE6OF01B9JYR.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagacgtccaccatccacgttcggcccgggccagtcaggtagttggtttcggtaccgttggttcggccgttggtactcgagacaacggaaaaccgaggggaaacgcccctaagccttcctgattcgtatgtatcggtcctacctaataggtaggtaacggtcgggtacccagtacgtaacggttcgaggcggactaggtcggtagtcgtagggaactaaggtaacttcacgtcctaccaacctactcgaacgcgaaccgtaccctacgacgtccgtaggtatttacggttacgttttcgaccgtttactttaatttacgtacgtaacccaaagttaacgttaattaaacggttaacgttttaaccttacgtttaacccggtttcccggaccggttacggaccgttaaggtacggtaggtaaacttaccgtaacggtaaaacgtacgttcgggtaccgtccgtacgaccctaacgttctaccgtttcgttctttaccccg

SEQ ID NO: 167418 - DNA, 581 bp, Homo sapiens
  misc_feature: GYAE6OF01DR6RY.16.81.H04.1.454.CMB.1.raw
  modified_base (191)..(191): a, c, t, g, unknown or other
  misc_feature (191)..(191): n is a, c, g, or t
  modified_base (260)..(260): a, c, t, g, unknown or other
  misc_feature (260)..(260): n is a, c, g, or t
  modified_base (324)..(324): a, c, t, g, unknown or other
  misc_feature (324)..(324): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctccaggtatcaaatgtgacatccagatgacccagtctccttccaccctgtctgcatctgtcgganacagatcaccatcacttgccggcagtcagagtgtgtactggttgctggtatcagcagaaacaggaaacnccctaagctctagatctatgatgtctacaatataggaaagtgggtccatacaaggttcagcggnagtgatgtggacagtaatcactctcaccatcagcanctacngtactgactgtatttcgcgtaactttattattcgaactaaacgtaagttaagtaaacgtagtttaacttaccgtaaccgttttcccggacccgtaacgggtaacctaaagttcgggtaacggtaacttaaacgttaaaccgaaaacggttaacgtacggttacgggtaccgttaccggacctaaaccgtagttacccggtttgttcgtttaacccg

SEQ ID NO: 167419 - DNA, 571 bp, Homo sapiens
  misc_feature: GYAE6OF01DUU9P.16.81.H04.1.454.CMB.1.raw
  modified_base (352)..(352): a, c, t, g, unknown or other
  misc_feature (352)..(352): n is a, c, g, or t
tcagtgtactactccacgaccggtgctcgatttagtagtgtagattcgcggggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcaagaaaccgagggaaacgcccctaagcctcctgatctatgattcgtctaccaatagtagggaaacgtcggggtacccatcgaaggttcaggccggngtaggtggagtcgtagggaacagtaattcacttcaccaccatcgagccacgtccctaacgacgtacctgtactgttattttcggacgttactttatttacgtacgacctaagtagttaataaggttactttacttaccgtaaccgtttccggacccgtagggacctagtgtagaatactacaaacgtacgtgtggactcgactacctatccttgttacc

SEQ ID NO: 167420 - DNA, 950 bp, Homo sapiens
  misc_feature: GYAE6OF01A9Y99.16.81.H04.1.454.CMB.1.raw
tcagtgtactactccacgaccggtgctcgattttagtagtgtagattcgcggggggtcaggactcaggtcgaggacacagcgagtggaccatgacgggtcccgcgtcagcgtcctcggggctccttcgcgtgccttctcggtctcccgaggtatacgaaattcgtagacgacttcctagatgtacccagttctacccttcccaccccttgtctgtccgtactcccgtcgtacgggaacgaacgacgacggtccaacctactaccgtacgtttcggcccgggtaccgaaggtcctaggtaagtttggtttacggttaaccgttgggtttacggtccttgggtacttccgtacggtacaacgaaaaccggagggaaaaccggaccccgtaacgccgttacccgcgtaccgtttactacgttacggtaacttcgttaccttaacctaaaagttacggtacggggtaaacggttcccggggttaccctaacggttacccgtaacgggttaccgaacgggtccggttaccgtaagggttccgggtaccttcccgggttaacgggtaacctaagggtaaacttacccgtaacgttacccgtacccgtaacctacgtacccgaagtcccgtaacggaccccggtaaccgaacggtacccgtttaaggtaacgttacggtttaacgggtttttaccggacctttaaacgtttttaaccgtttaacgtttacccgtaaccgttaaacgtaacggggtttaaacgtttaacgggttaaccgttttaaacggtttcccgttaaaccgggtttttcccgggggacccggttttaacgggggtaacccgttaaggggttcgggtaccggtaaacgttttaccgaaccggttaaaacccgggttagttcgggtacgaccgttacggaccgttacccgtaccgtccctttaggttcccttaaccg

SEQ ID NO: 167421 - DNA, 914 bp, Homo sapiens
  misc_feature: GYAE6OF01DQ8MT.16.81.H04.1.454.CMB.1.raw
tcagtgtactactccacgaccggtgctcgatttagtagtgtagattcgcgggggtcgagactcagtcaggacacagcatggacatgagggtccccgctcagctccgtggggctcctgctgctctggctcccaggtatcaaatgtgacatccagatcgacccagttccttcccttcccacccttgtctcgcctatcgtggtcggagacagacgtccaccattcaccgttcggcccgggcctaagtcgaaggtcggttggtttacgggttaccgttcggggttcggtccgttagggttactaccgaaggaccgaaacggaaaacccggaacggggaaacccgtaccccgtaacggcccttccgtagtacttactagttagtacgttacgttacctaaccgtaaagttaggtaacggggtaacgggttacccggggttaaccctacgttaacgtaaacgggttaccgaccgggtacggggtaaccgtaggggtacggtagttaccgggtacgggtaagttaaacgtactttaacccgacctttaccgtaaccccaaccttacgccgacggtaaccgtacccgtaaccttaaccgtaccggcgtttaacggtagtttacgtttacgggttttacctaacggttttaacttttaacgtttacgtaaccgtaactaaacggttaagttaagttaaacggttttacgtttaaccgttttaacccgttaacccgggtttcccggttaaaccgggttacgggtaaaccgttaacgtttcggggttaaaccgtttaaacttaaacgggttaaaccccggtaaaaggtttaaccgggttcgggttaaacccgggtacccgtttacccggtaaaccccgtacccgttttaaaggtttcccttttaacgggttccccttttacccgg

SEQ ID NO: 167422 - DNA, 566 bp, Homo sapiens
  misc_feature: GYAE6OF01A66OC.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgtggtacctggttgcctggtatcagcagaaaccagggaaacgcccctaagctcctgatctatgatgtctacaatatggaaagtcgggtcccagtcgaaggttcagcggcagtggatcgagggactagtaactcgactctcaccatcagcacgacctacacgtcctgtaattgtacgttttgaccgttactttattacttacgacctaactaagttaactaagtagtttacttacgtaaccgtttccggacccgtagggaccctaagttcggtaggtacttaacgtaccgtaaacggtactcggtaggtcctacgacctacctattcccgtgttccgttaccg

SEQ ID NO: 167423 - DNA, 702 bp, Homo sapiens
  misc_feature: GYAE6OF01AVXW9.16.81.H04.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
tcagtgtactactccacgaccggtgctcgatttagtagtgtagattcgcgggggagtcagactcagtcaggacacagcatggacatgagggtcccgctcagctcctggggctcctgctgctctggctccaggtatcaaatgtgacatccagatgacccagtcctccttccaccctgtctgcatctggtcggagacagacgtccaccatcacgttgccgggacagtcagngttgttcggtactggtggcctggtatcgagcaagaaaccgagggaaacncccctaagctccgtagactctagtcgtattcgtacctacctaatacgtagggtaaacggttcggggtaccccaagttaccgtaaagggttcacgggccgggtacaaggttacgggtagttccggtaggggaactaacggtaacgtttccgaaccgttcctaccaaccctacgttacgacgtaccgacggtaccctaacgacgtccctaggtactcggttattttcggaccgttaactttacttacgttacgaacctaaacgtagttaaactaaggttaacgtttaactttaccgttaaccggtttcccgggtacccgttaacggggtaaccctaggtttacggtacggtaaacttacgttaaccgaaacggttacgttagggttaccgcgttacgaccgtaacctacgttgtttccgttacccg

SEQ ID NO: 167424 - DNA, 747 bp, Homo sapiens
  misc_feature: GYAE6OF01CJA8F.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccgaggtatacaatgtgacactccagatcgacccagtcctcccttcccaccctgtctgcatcgtcggtcggagacagagtaccacctatcctacgttcggccggcagtcagtgttgtcggtactggtcgcgtgtactacgagacaacgaacgacggaacctccctagcctcgtatactacgtatgtacgtcgtacctaacgtaagttacggtaagggtaacggtccgggtaccctagtacggtaagtcggacggtccggtaacgtggtacgtaggtaccggtacgggaactaacggtacttaccgaccttacctaacccgtaactacgtaccgacgaacccgtaccgtaacccgtacggacgttccgtagttacgttacggttttacttacggttacttaacttttacgttaccgtactaaaccgttaaagtaagttaactttaaacggtttcgtttaaacgtttacccgttaccggttaccccggttaccggtaacggtaaccgttaggttacggtacgttaaacgtaccgtttaaaaccggaaacggttccggttcgggacgttacccgtaccgtaaccttaccccgttatttccggttaccctttacccggttaccc

SEQ ID NO: 167425 - DNA, 791 bp, Homo sapiens
  misc_feature: GYAE6OF01DEYVB.16.81.H04.1.454.CMB.1.raw
tcagtgtactactccacgaccggtgctcgatttagtagtgtagattcgcgggggagtcagactcagtcaggacacagcatggacatgagggtccccgctcagctccgtggggcctcctgctgctctggcctcccgaggtatcaaatgtagacatccagatcgacccagtccttcccttcccaccctgtcctgctatcgtggtcggagaccagacgtccaccatctaacgttcggacccgggaccagtacgaggtaggtggtttacggtaccgttgggttcggtccgtagggtactacgacgacgaacggaaaccgaacgggaaaccgacccctaagccgttctagtactctagtgtactcgtactactaagtaggtagggtaaacggtcggtacctagtacgtaaggttacgacggcggacgtaggtaggtacgtacggtagggaacgtaacggtaactttaccgtaacccttaccgtacctaacccgttaacgtaccaccggtaaccgtaccgtaaccccttaaccggacgttacccgttaaggtacgttttaacgttacggtttttaaccggacgtttaacttttaacgtttaacgttaccggtaaaccttaaggttaaacgttaaacgtttaaagttaaccgttttacgtaacgtttacccgggtttacccgggtacccggttaacgggtaaaccttagggttacggtacgtaaacttaacggtaaaccgttaacgtaacggttgggtacgacgttacgaacccgttagtacttgttagtttaccccg

SEQ ID NO: 167426 - DNA, 797 bp, Homo sapiens
  misc_feature: GYAE6OF01DC19H.16.81.H04.1.454.CMB.1.raw
  modified_base (562)..(562): a, c, t, g, unknown or other
  misc_feature (562)..(562): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgctatcgtggtcggagacgagacgtcacatcctacgttcggcccgggccagtcagtagttggttcggtccgttggtcggctggtatcgagacgaacgaaacgaacggaaccgccctaagctcctagtactctagtgacttcgtacctaccgtaaattaggtaacgggtaaacggttcggggtaccctaacgttaacggtaacggttacgacggtacggtacgttagggtacggtacggtcggtacgggaacgttaaacggtacgttttaccaccgttacgttacccaacccgtagtaccgaacgacccggtaacgtaccccgtacgtaaccgtccgtaagttacgttacggtttacgttttacggtaaccgtttaacgttttntttaacccggttaccgtaacccttaaaacgttaagttttaaaagtaaacggttttaacttttaccgtttaaccggtttaaccccgggtttacccggttacccccgggaagggttaaccccgttaaggttacgggtaaggtaaagttaaccgtaaaccggttaaaggttaccgttacgggtacgtaccgtacccgtacccgtaacttaccgtttcgttcccgttaccgtttacccg

SEQ ID NO: 167427 - DNA, 711 bp, Homo sapiens
  misc_feature: GYAE6OF01EMTTJ.16.81.H04.1.454.CMB.1.raw
  modified_base (366)..(366): a, c, t, g, unknown or other
  misc_feature (366)..(366): n is a, c, g, or t
tcagtgtactactccacgaccggtgctcgatttagtagtgtagattcgcgggggtcagactcagtcaggacacagcatggacatgagggtccccgctcagctcctgggctcctgctgctctggctcccaggtatcaaatgtgacatccagatcgaccctagtctccttccaccctgtctgcatctgtcggagacagagtcacatcacgtcgccggcagtcagagtgttggtacctggttgcctggtatcgagactaacgaaaaccgagggaaaccgccccgtaaagcctaccgtgacttcgtaagtgtatcgtactaccgtaaattggtaggaagggttcgggtacccaagtacgtaaggttacgnggtacggactaggtacggattcggtagggaacctaagtaactcctaaccgttacgtacccaactacgttaccgacgtccgaacgtacccgtaaacgcgtaccttaaggtactttaggttacgtttttacgcgttaaaacgttttcgttaaccgtcgtaaacccgtattaaagttaaacgttaaaggttacgttttaacctttaaccggtaaccgtttttacccggacccgtaacgggtaaccttaacgggtgttacgggttaaacttaacgtaaaccgtaaaacgtcggttcggtacggaccttacggaccctaacgttactcggtttaccgttcccttaaaccg

SEQ ID NO: 167428 - DNA, 772 bp, Homo sapiens
  misc_feature: GYAE6OF01A4O0O.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtccacatcacttgccggccagtcagagtgttggtactggtgctggtatcagacaagaaaccgagggaaacgcccctaaagccttaccgtagtactactagtcgagttcgtaccgtacctaaagttaggtaacggggtaaaacgggttccggggtacccctaagttaacggtaacggtttacgaacgggtccggtacgtaagggtacgggtaattccggttagggaactaaacggtaactttacccgtaaccttccgtaacccaaccgtaagttaccgagtacccgaacgtaccctaaccgacgtcccttaggacctttaggtacgtttttagaccggtttaatttaacgtttacgttaccgaaccgttaaactaaaggttaagtttaaacggtagtttttaaacctttacccggttaaaacccggtttcccggtaacccgggtttaaccgggtaaccgttaaagtttcgggtaacgtaaacttaaaccgttaaacgaaaaccggttacgttagggtcccgtaacgtaccgtacccgtacctacgtttacccgttatttccctacgtttaaccccg

SEQ ID NO: 167429 - DNA, 544 bp, Homo sapiens
  misc_feature: GYAE6OF01A8RB8.16.81.H04.1.454.CMB.1.raw
  modified_base (290)..(290): a, c, t, g, unknown or other
  misc_feature (290)..(290): n is a, c, g, or t
  modified_base (342)..(342): a, c, t, g, unknown or other
  misc_feature (342)..(342): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctctgatctangatgtctcaatataggaaagtgggtccatcaaggttcagcggcagtgatcgnggacagattcactctcaccatcagcacgcctacacgcctgatgtattttgacgtactttattattcgacctaacagttaactaaggtacgtttaatttactaacgtttccgacccgttagggaccctaagttgtaacggtactaacgtaccaaacggtaacgtcgtcgggacttacgacctaacctagttacctggtttccc

SEQ ID NO: 167430 - DNA, 594 bp, Homo sapiens
  misc_feature: GYAE6OF01CIR8D.16.81.H04.1.454.CMB.1.raw
  modified_base (272)..(272): a, c, t, g, unknown or other
  misc_feature (272)..(272): n is a, c, g, or t
  modified_base (579)..(579): a, c, t, g, unknown or other
  misc_feature (579)..(579): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatccacttgccgggccagtcagagtgttggtacctggttggcctggtatcagacagaaaccagggaaacncccctaagcctcctgatctatgatcgtctaccaatagtagggaaaggtcggggtaccccagtaccgtaaggtttccaggaccgggctaagggtggagtcgtggggaacagtacttaccgactcgtaccacctatccgagaccacgaccttacgacgtccttagacgtgttacttttggccgtaactttatttattcgtacctaaacgtagtaagtaagttagtttaacttacgtaaccgttttaccggcccgttaggaacctagtagtcgaatactaccgaaagtacgtgtacgcttacgccaactnttacctgttcttacc

SEQ ID NO: 167431 - DNA, 702 bp, Homo sapiens
  misc_feature: GYAE6OF01A8S9A.16.81.H04.1.454.CMB.1.raw
  modified_base (191)..(191): a, c, t, g, unknown or other
  misc_feature (191)..(191): n is a, c, g, or t
  modified_base (265)..(265): a, c, t, g, unknown or other
  misc_feature (265)..(265): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcacatcacttcgccggcagtcagagtgttgtactggtgcctggtatcagcaagaaaccgaggaaacnccctaagcctctgatctagtgagttcgtctaccaagttagtagggtaaaacggttccggggtaccctaagttaccgtaaacgggtttaccgaaggtaccgggtaccgtaagggttacgggtaacgttaccggttagggggaaactaacggttaaaactttccgtaaaccttcccttaaccgaacccgttaagttacccgaacggtacccctaacgtaccccttaacgacgtacccgtagtaacgtttagttacgttttacgtaccgtttaacttttaacttacgttacgaaccctaaagttacgttaaagttaagttacgtttaacttaccgttaaaccgttttcccggacccggtaggtaacctaagttaggtacgtaataacgtaacgtaaacgtagtggtacgcgtagtaaccactagttctcgttcttacccg

SEQ ID NO: 167432 - DNA, 620 bp, Homo sapiens
  misc_feature: GYAE6OF01EBPWD.16.81.H04.1.454.CMB.1.raw
  modified_base (192)..(192): a, c, t, g, unknown or other
  misc_feature (192)..(192): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttggccggccagtcagagttgttggtaccttgggttgccttggtatcagcaagaaaccgagggaaacgcccctaagcctcctgatctatgatcgtctacaatatagggaaggtcggtaccatcaaggttcagcgacgagtggatcgtagggacagtaatcactctacacctatcagacacgcctacgacgcctagtagttaggttacttttacggacttaacttttatttacgttacgtaaccctaaacgtagttaaagttaacggttacgtttaactttaaccgttaacggttttcccggacccgttagggtaaccctagtacggttaggtaacttaaacgtaaccgtaaaacggtacttgggtacggtaccgtacgtacctacccgtactttccttcgttcctttacccg

SEQ ID NO: 167433 - DNA, 780 bp, Homo sapiens
  misc_feature: GYAE6OF01B9KYE.16.81.H04.1.454.CMB.1.raw
  modified_base (194)..(194): a, c, t, g, unknown or other
  misc_feature (194)..(194): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
tcagtgtactactccacgaccggtgctcgatttagtagtgtagattcgcgggggtcagactcagtcaggacacagcatggacatgacgggtccccgctcagctcctggggctcctgctgctcgtggctccaggtatcaaatgtgacatccagatcgacccagtcctccttccacctgtctgcatcgtgacgganacagactaccacatccgacgttcggccgggctagtcgagtagttggttacggtacgtggttcgccgtgtacncgagacaacggtaaaccgagggaaccncccgtaagcctaccgtagtacttacgtagtagtcttacgtacctaacgtaagttaacggtacgggtaaacgggttccggtaacctagtaaccgggtaagttccggacggtccggaagttacgggacggttaaccgtacgggtaacggtaaacgttaacggtttaccttaccgtaaccgtttacccaaccggtaaccttaacgtaccgaacgaacccgttaacccgtaccgtaaaccggtaacccgtttacgtttaagggtaacttttacgggttaacgtttttacccggaaacttttaacgtttaacgtttacgtaacccggaaacttaagttaaagtttaccgttaaagttacgttttaccgttaaccgttaccgggttccgtaacggtacgttaacgtggttaacgtacgttaagtaccgtaaacgtaacggttaggtcgttcggaactcccgtaactaccttaatttccgtgttcccttaaccg

SEQ ID NO: 167434 - DNA, 743 bp, Homo sapiens
  misc_feature: GYAE6OF01EIKZ4.16.81.H04.1.454.CMB.1.raw
  modified_base (194)..(194): a, c, t, g, unknown or other
  misc_feature (194)..(194): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatcgacccagtcctccttccaccctgtctgcatctgtcgganacgagacgtcaccatctacgttcgcccggccagtcgagtagtgttcggtaccttggttcggccgttggtactcgagacgaacggaaaccgtaaggggaaaccgtaccccgtaaacggtcccttcccgttaggtactttaccgttaagttaggtacgttacggttaccttaaccctaaagttaacggttaaggggtaaaacgggttccggggtaaccccctaagttaaccgtaagggtttaccgaacggtccgggaacggtacggtacgggtaagttccggtaacggggtaaccgtaagtaactttaccaccgttacctacctaaccgtaactacgaacgtaccgaaccgtaccttaacgacgtcgtacgtattacggttactttcggtacgttaactttagttacttacgaacctaagtaattaagtaagttacttacgttaaccgtacgtttacccggtaccgtacggtaactagtgttaacgacttaacgtaaccgtaacggtaacgtgtaccgtcgacgtacctacgtattctacgttccttaccg

SEQ ID NO: 167435 - DNA, 737 bp, Homo sapiens
  misc_feature: GYAE6OF01DCPCT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagacgtcaccatcctacttcgccgggccagtcaggtagtgttggtaccgtggttggccgtggtatcagcaagaaaccgaagggaaaccaccccgtaagcctcctgactactatgatcgtacctacctaagtagtaggtaaacggtcgggtaccctaagtacgtaaggttacgaggacgacgtaggtggtacgttcggtacgggaacgtaagtaacgtttacaccgttactaccaacctagtacgacgaccaaccgtacccttaacgacgtaccgtagtaacgttacgtttagttttaggaccgtttaacttttagtttaccgtttaacgaacctaaacgttaagttaaacgttaaggttaacgtttttaacgtttacccgttaaccggttttaccccgggacccgttaggggtaaaccttaaacggtttagggtaacggttaacttaaaacgttaaaccccgtaaaagggttaccgttaaggccgggttactacggtaaccctaacccttagtttcccgttagttttacccccgtttccccgg

SEQ ID NO: 167436 - DNA, 614 bp, Homo sapiens
  misc_feature: GYAE6OF01ECFCW.16.81.H04.1.454.CMB.1.raw
  modified_base (291)..(291): a, c, t, g, unknown or other
  misc_feature (291)..(291): n is a, c, g, or t
tcagtgtactactccacgaccggtgctcgattttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagacgtcaccatcacgttcggccggccagtcagtagttgttcggtaccttgggttcggccttggtactcagacaacggaaaaccgaacgggaaacnccccgtaagccttacctagactctagtgtattcgtctactaatagtagggaaacggttcgggtaccctagtacgtaaggttcgacggcggagtaggtcgagtcgagggaacagtactcgactcacacactacacgtcaacgtacctacgacgtcctagtagttgttatttcgacttaactttatacgtacaacgtaatagtaagtaagttacttacttaccgttaaccgtttccggaccgtaggaacttaggtagtagtaatacgtaaacgaacgtacgtggtaccgacgtaccgacctaacttattcgttcgttccttaccg

SEQ ID NO: 167437 - DNA, 685 bp, Homo sapiens
  misc_feature: GYAE6OF01BWVSA.16.81.H04.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (433)..(433): a, c, t, g, unknown or other
  misc_feature (433)..(433): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctcccttcccaccctgtctgcatcgtgcgganacagagtcacatcactcgccggcagcagngttgtggtacctggttcggctgtatcagacaacgaaaccgaaggaaaccgacccctaagcctccgtagtactctatgattcgtacctaccgtaagtagtaggtaaaggtccgggtaccagtaccgtaaggttcgaggccgagacggtagagtcggaggtactaagtacttaccgactcctacactactacgacggaccacgaccgtacncgttaccgtagtagtttacgttagtttaccgcgtttaaccttttagttacgtaccctaaaccgtaaacttaaggttaaactttaacggtttaactttaaccgttaacccgttaaccgggttttcccggtaaccccgttacgggtaaactttaacggtagggtacctaaagttaacccgtaaaccggtaaagtacggttcggttacgtacggtacctacctaacgttacttcccgtttagttcccttaccccg

SEQ ID NO: 167438 - DNA, 786 bp, Homo sapiens
  misc_feature: GYAE6OF01B0MS3.16.81.H04.1.454.CMB.1.raw
  modified_base (148)..(148): a, c, t, g, unknown or other
  misc_feature (148)..(148): n is a, c, g, or t
tcagtgtactactccacgaccggtgctcgatttagtagtgtagattcgcgggggtcagactcagtcaggacacagcatggacatggacgggtccccgctcagctccgtggggctcctgctgctctggctcccaggtatacaaatggtnacatccagactcgaccctagtccttcccttccaccctgtcctgctactcgtggtacggagacaggacgtaccaacctatccgtacgttccgggaccgggtacctagtaccgtaaggttacggtttcggttacgggttaccggtttggggttcggtcccgttagggttaactccgaacgtaccgaaaacgggtaaacccggaacgggggtaaaccctaccccgttaagtcccgttacgttacggtaactttaccgtaagttacggtacgttaccgttaaccttaaccgtaaaggttaaccggttaacgggggttaaaaccgggttccggggtttaaccccaaggttaaccggttaacgggttccgaacgggtccggtaacgttaggttacggtgttaccggaaggtaacgaacgtttactccgtactccaccgtaactcgtaaccgctaacggacctacgacgtacgcttagtattaacgtttcgttacgttaacgttacttaattacgtaacccagttaaacgttagtaacttaaggttacttacgttaccgtacggtttccgagtacggaactaggttgactaaataccgaagtaagtcgttgtccgacacggtacctacttctcttgccttaccgg

SEQ ID NO: 167439 - DNA, 690 bp, Homo sapiens
  misc_feature: GYAE6OF01AB61M.16.81.H04.1.454.CMB.1.raw
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtgacatccagatgacccagtctccttccacctgtctagcatctgtcggagacagacgtcaccatcacgttcgccggcagtcagtagtgttgtacctggtgctggntcagcaagaaccaggaacnccctaagcctcagtactctaatgtactcgtactacaagtacgtagggaacggtcgggtacccaagtcgtaacggttcgaacggtcggacgtaggtacggtacgtacggttagggaactacgtaacttaccctaccttaccgtaaccaaccctacgttaccgacgtacccgtaaccgtacccctaacgtacccggtaccgttaggtacgtttaggtttacgttttacggaaccgtttaactttagtttacgttacgaacctaaacgtaagttaacgttaaaggttaacgtttaccgtttaccgttaaccgtttacccggtacccggttacgtaccgtaagttacggttaagtacttaaacgtaaccgtaaacgtacggttcggtaccgtacttacgtaccgtacttattcgttaccttgtttacccc

SEQ ID NO: 167440 - DNA, 747 bp, Homo sapiens
  misc_feature: GYAE6OF01EBDAJ.16.81.H04.1.454.CMB.1.raw
  modified_base (285)..(285): a, c, t, g, unknown or other
  misc_feature (285)..(285): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccacctgtctgcatctgtcggagacagacgtcaaccatcacgttcggccgggccagtcagtaggtgttggtaccgtggttggccgtggtactcagcaacgaaaccgagggaaaccnccccgtaagtcctcgtagtactctatcgtatcgtacctactaagtagtacggaaggtcgggtacccagtacgtaacggtcgacggcggacgaggtcggagtacggtaggactaagtacttacctaccgtacctaccaccctaatccgaacgaccgtaaccgccgttaaccgacggtaccgtaggtacgtttacggttacgtttttacggacgtttaacttttaacgtttacgtttacgaaacccgttaaagtaagtttaaacgtaagttaccgttttaactttaacccggtttaacccgttttcccgggaacccggttacgggtaaaccgttaagttcgggttaaccggttaaacttaaaccggtaaaaccggtaaaccgggtttaactttcggggaacggttacccgtaccgtaacccgttaacccgttacttttccggttcccgtttaccgtttaacccg

SEQ ID NO: 167441 - DNA, 629 bp, Homo sapiens
  misc_feature: GYAE6OF01EUX0L.16.81.H04.1.454.CMB.1.raw
  modified_base (427)..(427): a, c, t, g, unknown or other
  misc_feature (427)..(427): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctcccttccaccctgtctgctatctgtcggagacagacgtcaccatcacgttcggcccggcagtcagtagtggttggtaccgtgggttcggccgtggtatcgagacaacgaaaccgaacgggaaccaccccgtaagcctcctagacttctagtagattcgtacctactaagtagtagggaacggttcgggtaccctagtacgtaacggtcaggccggtagagtggatcggtacggaactagtaactctacctcctaccaacgtacncgacgccaacgccctacgcgtacctagtattagttacgtttcgacttattactttacgtcgaacctaagtaagttaagttaacgttaatttactaaccgttaccgttccggtacccgtacggaacttagtcgttagaacttaacgtaacgtaaacgtcggttgacggtacctcgacccttacttatccgttcttcttacccg

SEQ ID NO: 167442 - DNA, 569 bp, Homo sapiens
  misc_feature: GYAE6OF01DUI25.16.81.H04.1.454.CMB.1.raw
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttcgccggccagtcagagttgttggtacctggtggcctggtatcagcaagaaaccgaggaaacgcccctaagctcctgatctagtgatcgtcctacaattagtagggaaaggtcggggtaccaagtacgtaaaggttcaggcggcgtaaggtggattcgagggacaagtattacactctaccaaccatacancacgcctaacncgtctgtattcgttatttgaccttattattagttcgaacaacgtagtaattaagtagtttattccgttaacgtttcggacccgttaggaacctaagtggtagtatactaaccgaaagtacgttggacgtcgtacgacctacctattcgttgttcttaccg

SEQ ID NO: 167443 - DNA, 767 bp, Homo sapiens
  misc_feature: GYAE6OF01ELJAE.16.81.H04.1.454.CMB.1.raw
tcagtgtactactccacgaccggtgctcgatttagtagtgtagattcgcgggggtcagactcagtcaggacacagcatggacatggagggtccccgctcagctcctggggctcctgctgctctggctcccaggtatcaaatgtgacatccagatcgacccagtcctccttccaccctgtctgcatcgtgtacggagacagacgtccacatcacgttcggcccggcagtcagtagttgttcggtacctgggttcgccgtggtatcgagacaacggaaaccgagggaaacctacccctaagccttaccgtagtactacgtagtacgtacttcgtacctaccgtaaagttaggtaagggtaaacggttcgggtaccctaagtacgtaacggttcgaacggcggtacgtagggtgtaacgtcggtaacgggaacgtaaggtaaaccttccgtaacgtacctaccgaacctataccgacgtaccaccgtaccctaacgtacgtaccgtagtacgtttacggttacttttacggaaccctttaagttttacgttaacggttaccgtaaacccgtaaaagttaaggttaaagtttaacggtttaacgttttaactttaaccccggttaaaccgttttcccgggaacccgttaagggtaacccttaaggtttacggttaacggtaaacttaaccggtaaaccgtaaaaccgggttacggttggtaaccggtcctaacgtaccaacccgttagttccttacgttaccgtttacccc

SEQ ID NO: 167444 - DNA, 811 bp, Homo sapiens
  misc_feature: GYAE6OF01E1O2F.16.81.H04.1.454.CMB.1.raw
  modified_base (786)..(786): a, c, t, g, unknown or other
  misc_feature (786)..(786): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagactgacccagtccttcccttccaccctgtcctgctatcgtggtcggaagacagacgtacaccattccacgttcggcccgggtcccagtcaggtagttggtttacgggtacccgttgggttcggccgttgggttactccgaggaccgaacggaaaaccgaaggggaaaccgtacccccgttaacggccttacccgtaggtacttaccgttaattggtaacttcggttaccctaaccctaaagttaaggtaaggggtaaaacggttccggggttacccaagttaccgtaacgggttccgaacggtccggacgtagggttacgggtaacgtccggttaacgggaaccgtaaaggttaaacccgtttacccgtaacccgtccccgttaaccctaacccgttaacgttaacccgaacggtaacccaaccgggttacccctaaccgacggttaccccgtagttaacgtttacggtttaacgttttaccggtaacggttttaaccttttaagtttaacgtacggtaaaccctaaacgttaaggttaaacgtttaaaggttacgtttaactttaccgttaaccggtttccggaacccgtaggtaacctaggtagtacgtaatactacgaaatacgtgtacgtntctacgtactacttctcgtcttacg

SEQ ID NO: 167445 - DNA, 885 bp, Homo sapiens
  misc_feature: GYAE6OF01CYP6Z.16.81.H04.1.454.CMB.1.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatgaccctagtcctccttccaccctgtctgctatcgtgtacgganacagatcacatctacgttcgccgggccagtcagtagtgtgtactggtgctggtatcgagacacgaaaccgagggaaaccncccctaagcctacctgtactactatgacttcgtactacctaagtacgtagggtaaacggttcgggacctagtacgtaaggttcgacgggtcggacgtaggtcggtacgtcggtagggaacctaagttaacgtttccaaccttcgtacccgaacctacgtaccgacgtaccgtaaccgtacccgtaaacggtaccgtcccgttaaggtaacccgtttaggtttaacccgtttttaccgggaacccgttttaaccgttttaaccggtttaaccgtttaacccggtaaccccgtaaaagtttaaccgggttttaaaacggttaaacgggtttttaaaccggttttaaacccgttttaacccggttaaacccggggtttttacccccggggtaacccccggtttaacggggggttaaaccccttaaaaacgggtttacgggggttaaaccgttaaaacccgtttaaccggtaaaaaccccggttaaaaacccggtttaaccgggtttaaccggggtaccggggtttaaccccttacgggttaaacccccggttaaaccccttaacggggtttttaaccccttccggggtttttaacccctttaaacccccgg

SEQ ID NO: 167446 - DNA, 766 bp, Homo sapiens
  misc_feature: GYAE6OF01BQGS5.16.81.H04.1.454.CMB.1.raw
  modified_base (668)..(668): a, c, t, g, unknown or other
  misc_feature (668)..(668): n is a, c, g, or t
  modified_base (742)..(742): a, c, t, g, unknown or other
  misc_feature (742)..(742): n is a, c, g, or t
tcagtgtactactccacgaccggtgctcgatttagtagtgtagattcgcgggggtcagactcagtcaggacacagcatggacatggacgggtccccgctcagctccgtgggctcctgctgctctggctaccaggtatacaaatgtagacactccgagtatacgaccctagtcctccttaccgaccgttgtctcgctactcgtcggtacggacgacgacggactccactatcctacgtcggaccgaccatcgagtgttcgttacgtcgtcggtcgcttagactacgacgaccgaaacggtaaccgaacgggaaccctacccgtaagtcctacgtagtactacgtagtcgtaccttcgtactaacgtaagtaacggtacggtaaacgggtccggtaacctaacgtacggtacggtacggcgggtacgtaccgtagggtaccggtactacgggtaacgggaacttaacgttactacccttacgtacctaacccgaacttacggaccacgaaccgtaccgtaccccttaaggaccgtgttaagttcgtttacgtttaacggtttctaaaacctttgttaaacctttggaaccccgtaataacggttaagttagtttaaccggtttaatttaccccggtaacgttccggttaaccccgggtgaaacccgttanaggtttaaagggtcctaaaaagtttaacgaaaccgggttaacctggttcgaaccgttaaccgtacaacccgttnttactttcggttcttacccgttac

SEQ ID NO: 167447 - DNA, 639 bp, Homo sapiens
  misc_feature: GYAE6OF01EZSI9.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccaggaaagccctaagctcctgatctatgatgtctaccgaataagtaggaaaaggtcggggtacccaatcgaaaggttcaaggcggcaggtggatcgtagggacagaatcaactctacaccatcagcacgacctacagcctgattgtattttcgacgtactttattagttcgaaccaacgtagttaacttaaaggtacgttttaacttaacttaaacccgtttttccgggaaccccgtttaggggaaacccgtaaagtttccgggttaaggaaacgtttaaacgtaaccgtaaaaaacccggttaaacggttcgggttaagggtaccgttaccggaaccctaacccttaaattcccgtttacggttccttttaaacccg

SEQ ID NO: 167448 - DNA, 592 bp, Homo sapiens
  misc_feature: GYAE6OF01DKUSM.16.81.H04.1.454.CMB.1.raw
  modified_base (434)..(434): a, c, t, g, unknown or other
  misc_feature (434)..(434): n is a, c, g, or t
  modified_base (576)..(576): a, c, t, g, unknown or other
  misc_feature (576)..(576): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatcgacccagtcctccttcccaccctgtctgcatcgtgtcggagacagacgtcaccatcacttcggccgggcagtcgagtagttgttggtaccgtgggttcggccttggtatcgaagacaaacggaaaaccgaacggggaaacgaccccctaagccttccgtagatactatgtatcgtactacaatagtaggaacggtcgggacccagtcgtaaggttcgaggcggacgaggtagatcgtgggaactagacttacactctacacatcgacgcacgtaccacngcctagtatgttatttacgacttacttattacgttacgacctaacgtattaacgtaattagtttacttactacgtttcgaccgtaggacctaagtgaggtattacgaacgtaaacgtagttacgaggtactcggactacgtnttcttcgttccttacc

SEQ ID NO: 167449 - DNA, 700 bp, Homo sapiens
  misc_feature: GYAE6OF01AR3GA.16.81.H04.1.454.CMB.1.raw
  modified_base (223)..(223): a, c, t, g, unknown or other
  misc_feature (223)..(223): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttcaaccctgtctgcatctgtcggagacagagtcaccatcacttgccgggcagtcagngtgttgtacctggttgcctggtatcagcagaaaccgagggaaacgcccctaagcctcctgatctatgatgtctaccaatagtagggaaaggtcggggtaccccagttaccgaaagggtttcaggcggtacgaggttaggtacttcggtaggggaacctaaggtaactttccgaaccttcctaccgtaaccctaagtccgaacggccaacggtaccccttaacgacggtcccgttagtaacgtttaggttaacgtttttcggacggttaaaccttttaagtttacgttccggtaaccctaaacgtaaggtttaacttaaacggttaagttttaaccgtttacccgttaaaccggtttttcccggggaccccgttaggggaaccccttaaggttggttacgggtaaactaacgttaaccggaaaacgtacggttggtacggtctacgacccgtaactatttccgttgttccctttaccg

SEQ ID NO: 167450 - DNA, 650 bp, Homo sapiens
  misc_feature: GYAE6OF01BZJ1G.16.81.H04.1.454.CMB.1.raw
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
  modified_base (605)..(605): a, c, t, g, unknown or other
  misc_feature (605)..(605): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatccacgttgccgggccagtcagtagtgttcggtacctggttgccttggtatcagcaacgaaaccgaggggaacncccctaagctcctgatctatgatcgtcactaatagaggaaggtcggtccatacgaaggttcnggcgcaggtgacgtgtggacagtacgtactcgtacctcaccgtaactcgtacgactcgacctacaacgtccgtagtacttattacgttttcgtacgtacgtttaatttagttaccgtacctaaacgtagtttaaacggttacgtttaacggttacgtttcccggttaacgggttaccgggtacccggtaaccgggaacgggtaaccggggtaaccggttaaagggtaccgtaacgttaacccgaaacggtaacccgttagggnggtaaccggtctaccggaacccttacgtacgtttcggtttacccg

SEQ ID NO: 167451 - DNA, 752 bp, Homo sapiens
  misc_feature: GYAE6OF01B714T.16.81.H04.1.454.CMB.1.raw
  modified_base (289)..(289): a, c, t, g, unknown or other
  misc_feature (289)..(289): n is a, c, g, or t
tcagtgtactactccacgaccggtgctcgatttagtagtgtagattcgcgggggtacagactcagtcaggacacagcaatggacatgacgggtccccgctcagctccgtggggctcctgctgctctggctcccaggtatcaaatgtgacatccagatcgacccagtctccttccacctgtctgcatctgtcggagacagacgtcacatcacttcggccggcagtcgagtagttgttcggtacgtggttcgccgttggtactcgagaccaaggaaaccgacggggaaacnccccgtaagcctaccgtgacttctatgacttcgtcctacctaatagtacgggtaaacgtcgggtaccctagtacgtaacggttcgaggcggatacggtaggacgtgtacgggactaacggtacttcgaacttccgacgaacctacgtcgaacgtacctaccgtacctaacgaccgtaccgttagttaagttacgtttacgttttacgaccggtttaaaccttttagtttaaccgttttacgaaccctttaaacgtaacgtttaagttaaaccggttaaacttttaccgtttaacccgtttaaccggttttacccggaacccggtttacgggtaaacccgttaaggttacggttaaaccgggtaaagtttaaccgtaaaccgttaaaccggttaacggttcggtacggttaccgttacggtaccctaacccgttagtttacccgttcgtttaactttaccccgg

SEQ ID NO: 167452 - DNA, 792 bp, Homo sapiens
  misc_feature: GYAE6OF01DDQ3D.16.81.H04.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (491)..(491): a, c, t, g, unknown or other
  misc_feature (491)..(491): n is a, c, g, or t
  modified_base (784)..(784): a, c, t, g, unknown or other
  misc_feature (784)..(784): n is a, c, g, or t
tcagtgtactactccacgaccggtgctcgatttagtagtgtagattcgcgggggtcggactcagtcaggacacagcatggacatgagggtcccccgctcagctcctggggctcctgctgctctggcctcccaggtatacaatgtgacatccagatcgacccagtcctcccttccaccctgtctgactatccgtggtcgganacagtacgtccacctatccacgttcggcccgggtcagtcagtaggttcggttggtaccgtggttcggccttggtatcgagacaagaaaacccgagggaaacnccctaagcctacctgtacttctaatgtacttcgtaccttaacgtaaagttaggtacgggtaaacgggttccgggtaccctaacgtaacgtaaacgggttcgaaggtcggtacgtaacgggtagggtcgttaaccgggacgggtaactaacgttaacttcccgtaacttccctaacgtaacccttaacnccgaacggtaccaaccgtacccgtagtaccgtacgttcgttaaagttagttaccgttttaccggaacgtttaaccttttaacgtttccgttacggtaaaccccttaagttaacggttaaacgttaacggttaacgttttaaacgttacccgttaccgttttacccggtaccccggttaagggtaaccttaacggtttacggaacggttaattaaaccgaaacgttaaaaccgtacggttacgggtacccgtacgtccgaaccgtaaacctcgttacccgttgtttaccccgtnttaccccg

SEQ ID NO: 167453 - DNA, 641 bp, Homo sapiens
  misc_feature: GYAE6OF01A6IVU.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggcccgggccagtcagtagtgttggtaccgttggttggcctggtatcagacaagaaaccgagggaaacgcccctaagcctcctgatctatgatcgtactacaatagtaggaaaggtcgggtaccagtacgtaaggttcaggcggataggtggatcgtagggactaagtaatcactcacaccatacagccacgacctacgacgtccgtagtacgttagttacgttttacgaccgtttactttaatttacgttaacgacctaaagttagttaacttaaaggttaacgttttaacttaccgttaaccggtttccggacccgttacgggtaaccttaaggttaggttacggtaaattaaccgtaaaccgtaaaaccggttacttacgggttaccggtacgttaccggacccttaccgttacgtttacccg

SEQ ID NO: 167454 - DNA, 814 bp, Homo sapiens
  misc_feature: GYAE6OF01DR7VH.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtccaccatcacttggccggccagtcgagtagttgttcggtacctgggttcggccgtggtaatcgagacgaacggaaaccgaacggggaaaccgccccgtaagcctaccgtagtatactatcgtagtcgtcctacctaagtagtagggaaacggttcgggtaccctagtacgtaacggttcgaggtccggacgtaggtacgggtactacgggtacgggaaactaacgggtaaacctttacgtaacccgttacctacccgaaccctacgtaccgacggtaccctaaccgtacccgttaacgaccggtacccgttaggtacgtttacggttacgtttttacgggaccgttttaaacgtttttaacgtttaaccggtttaccgtaaaccgttaaaccgtttaaaggtttaaacgtttaaaaggttaccggtttttaaaccgtttaacccgtttaaaacccgggttttcccggttaacccccggttacggggtaacccttaagggttacggttaaacggtaacgtttaaaccgttaaaccggtaaacccggttaagttcgggttacggttccgtacccggaacttaacccgtacgttttccttccggtttacctttaccccg

SEQ ID NO: 167455 - DNA, 689 bp, Homo sapiens
  misc_feature: GYAE6OF01B3WQM.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatcgtgtcggagacagagtcaccatcacgttgccgggccagtcagtagttgttggtacctggttcggccttggtatcgagacaaggtaaaccgaaggggaaaccaccccgtaagtcctccgtagtacttcgtacgtgtacttcgtacctacctaagtaggtagggtaaacgggtcgggtacccagttacggaaaggttccgaggcggtagtaggtggtactacggtagggacaaggttaacttccgtactaccgtaccaccagtaccgacgactaaccggtacctaaccgacggtaccttaggacgttaggttacttttacgggactttacgttttaacttacgttaccgaacctaagtaagttaattaacgttacgtttacttacccgtaccggtttaccggtccctagggtaacctaggttacggtacggtaaacttaccgtaacgtaacgacggttggaccgtacgttacgaccctaacgttagttcgttcccttcgtttacccg

SEQ ID NO: 167456 - DNA, 588 bp, Homo sapiens
  misc_feature: GYAE6OF01C1EF8.16.81.H04.1.454.CMB.1.raw
  modified_base (361)..(361): a, c, t, g, unknown or other
  misc_feature (361)..(361): n is a, c, g, or t
  modified_base (463)..(463): a, c, t, g, unknown or other
  misc_feature (463)..(463): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagacgtccaccatcacttcggcccggccagtcagtagttgttggtaccgtggtgcctggtatcagcaagaaccgagggaaacgccctaagctacctgtatctatgtatcgtcctaccgtaataggtacggtaaaggtccgggtaccctatacgtaaggtcgacgcggngtaggtggactcgaggacaagtacttcaccgtactccgactagtcagcacgtacctacacgtctagtattagttactttcgacttacttattagtcactaanagttaagtacgtacgtttatccgtaacgttcccggacgttaggacctagttggtaacgtactaactacgaaaacgttgttaggtcggtagtacgaccctactcgttacttcgtccttcgtacccc

SEQ ID NO: 167457 - DNA, 736 bp, Homo sapiens
  misc_feature: GYAE6OF01BCGAY.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatggacccagtctccttccaccctgtctgcatctgtcgagacagagtcaccatcacttgccggccagtcagagtgttggtacctggtgcctggtatcagcagaaaccagggaaacgcccgtaagctcctgatctatgatgtcctccaaattatagggaaagttcggggtacccataccgtaagggttcaacggcggcgtacggtggtaagttccgtaggggaacctaggtaactttaccgacttccgtaccacctacgttccgacgaccacgtaccccttaaacacggtaccccgttagtaacgttacgttaacgttttttacgacggtttaaccttttaagttttaacgtttacggtaccctaaaacgttagttaaacgtttaaacggtaacgtttttaacgtttaacccgttaaacccgttttacccgggtacccccgtttagggggtaaaccccttaaaggttacggtttacgggtaactttaaacgttaaaccgaaaaccggttaaacgttacgggttccggacgttaccggtacctaaccgttactttacccgttacgtttccgtttcccttaaccccgg

SEQ ID NO: 167458 - DNA, 681 bp, Homo sapiens
  misc_feature: GYAE6OF01DEVM4.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatcgacccagtcctccttccaccctgtctgcatcgtgtcggagacagagtcaccatcacttcggccgggccagtcagtagtcgttacggtaccgtggttcggcctggtactcagacaaggaaaccgagggaaacgccctaagcctctgactctagtgactcgtcctaccaagtagtagggtaaacggtcgggtaccagtcgtaaggttcaggcgagagtggactcggtggactagtactcacgtcctacaccatccgacgaccacgtccctaacgacgtcctaagggtacttacggttacttttacggaccgtttaacttttacgtttacgttaaccgaaccgttaaacgttaacgtttaaagttaaaccggtttaacgttttaaccgttaccgttaaacccggttttccccgggaccggttaacggtaacccgtaacgttgggttaacgaacgtttaacgtaaccgtaaaacggtcgttacggtacggtaccgttacgaacctaccttacgtccgtttcgtttaccc

SEQ ID NO: 167459 - DNA, 708 bp, Homo sapiens
  misc_feature: GYAE6OF01BI2LU.16.81.H04.1.454.CMB.1.raw
tcagtgtactactccacgaccggtgctcgatttagtagtgtagattcgcgggggtcagactcagtcaggacacagcatggacatgacgggtccccgctcagctccgtggggctcctgctgctctggctcccaggtatacaaatgtgacatccagatcgacccagtcctcctcccaccctgtcctgactatccgtggtacgagacagtacgtacacctatcgtacttcggccggcagtacgagtagttggttcgtactgggttacgctaggtactcgagtacgaacgaaaccgaagggaacctacccgtaagtcctaccgtagaacgttcctagtagtaacttccgtacctacgtaagtacggtacgggtaaacgggttccgggtaaccctagtacccggtaaggttccgaaggcgtacgtagggtacgtcgtacgggtaggaactaacggtacttccctaacgtcctaacgaacctactacgacggaccctaacggtcctaacgcgtactagtacgttaggtttacttacggacctttaatttaaccgttagaccgtaaccaagttaacgttaagtaagtttacgtacttacccgttacggttcccggaccgtaggttaaactggtaacgggttataaacctaggtaaacccgaagtacctggggaatcccggaaacgtcaaccttacgtccttagtccctttaaccg

SEQ ID NO: 167460 - DNA, 787 bp, Homo sapiens
  misc_feature: GYAE6OF01BZTGF.16.81.H04.1.454.CMB.1.raw
  modified_base (192)..(192): a, c, t, g, unknown or other
  misc_feature (192)..(192): n is a, c, g, or t
  modified_base (418)..(418): a, c, t, g, unknown or other
  misc_feature (418)..(418): n is a, c, g, or t
  modified_base (501)..(501): a, c, t, g, unknown or other
  misc_feature (501)..(501): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtcctccttccaccctgtctgcatctgtcgganacagcgtccacctatctactcggcccgggccaggtcaggtagttcggttcgggtaccgttcgggttcggccgttggtatccgagacgaacggaaaccgaacgggtaaccaccccgtaagcctaccctagtacttaccttaagtcgtacgttcggtaccctacctaaaggtagtaacggggaagggttcccggggtaccctagtaccgtaagggttcgaggccggtntacgggtaggtacgtaggtcgggaacgtacgtaacttccaaccgttctaccctactactacgacgaccacggtacccgtaacncggtaccctaggtacgttagttacggttttacgtacgtttaaccttttaactttacggttaccgtaaaccgttaacgtaaggtttaaacgttaacggtttaacctttttaaccgtttaacccggttaacccggtttttaccggggaccccgttaacggggtaacccttaaggttacgggtaacgtaactttaaacggaacccggtaaaggttacgttacgggttcggaccgttacggaacccttaccgttacgtttacccggttctttccgtttaccttaccccgg

SEQ ID NO: 167461 - DNA, 647 bp, Homo sapiens
  misc_feature: GYAE6OF01A649R.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccggcagtcagtagtgttcggtacctgggttcggcctggtatcagcaaggaaaccgaagggaaacgccccgtaagcctacctagatctatgatcgtctactaatacgtaggaaacgtggggtacccaagtacgtaacggttcgaggcgacgtaggtcggaatcggtagggaacaagtaacttcacttaccgactacctagtcacgacacgtacctacgacgtaccgtagtaattcggttatttcggtaacgttactttaattagttacgacctaaacgtagttaaagttaagttaacgtttaacttaccgtaaccgtttccggtacccgttacgggaaccctaaggttcggtacggtaagttaacgtaaccgtaaaaccgtaacggttaggtacgtacgttacgtacctaaccttacgttcttccgttacgtttaccc

SEQ ID NO: 167462 - DNA, 612 bp, Homo sapiens
  misc_feature: GYAE6OF01D3ZNQ.16.81.H04.1.454.CMB.1.raw
  modified_base (191)..(191): a, c, t, g, unknown or other
  misc_feature (191)..(191): n is a, c, g, or t
  modified_base (272)..(272): a, c, t, g, unknown or other
  misc_feature (272)..(272): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttggccggccagtcagagtgttggtacctggttggcctggtatcagcaagaaaccgagggaaacncccctaagctcctgatctatgatgtactacaatagtaggaaaggtcgggtaccatcgaaggttcagcggctaggtggatcgtagggacagtaacttcactcacaccatcagcacgtcctaacgacgtcctagacttaggttacgttttagacgttaaacttttagtttacgttacgacctaaacgtaaggttaaattaaagttacgtttaactttaccgtaaccgttttccggacccgttagggtaacctaaggttgtaacggtaattaacgtaaccgtaaaacggttacttggtaccggtctacggaccctaacctagttccgttacgttccgtttacc

SEQ ID NO: 167463 - DNA, 774 bp, Homo sapiens
  misc_feature: GYAE6OF01AF9D4.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctggtcgagacagacgtcaccatcacgttcggcccgggccagtcagtagttcggtttcggtaccttgggttcgggccttgggtacttacgacggaccgaaacggaaaacccggaacgggggaaaaccgccccccgttaaaggcccttccgtacggtacttacttaagtacggtagttcgtaccttaccaataaggtagggtaaacggtcgggtaccctacgtacgtaagggttcacggtcgggacgtaggtacggtagttaccggtagggaacgtaagtaacgtttaccgacttccgtacccaacctataccgacgacctcgaaccctagaccgtcgtaaggtactgtttccgttttaacgcgttactttacgttaacttccggtaactaacgtaagttactttaaacgggtacttttaacgttacccgttaccggttttaacccggccgggttacccggaaaccgttagtttgggttaacggttaaagttaaccgtaaacggtaaaccggttaaccgttgggttaacccggtacgtttaaccgggaccttaaacccggttactttcccggtttcgtttaccggtttaccc

SEQ ID NO: 167464 - DNA, 618 bp, Homo sapiens
  misc_feature: GYAE6OF01BT262.16.81.H04.1.454.CMB.1.raw
  modified_base (221)..(221): a, c, t, g, unknown or other
  misc_feature (221)..(221): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcactgccggcagtcagngtgtgtactggtgctggtatcgagcaagaaccgaggaacgccctaagcctcctgatctagtgattcgtactactaagtagtagggtaaacggtccggggttacccagttaccgtaaggttaccgacggtcggacgtagggtcggtaatcggtacgggacaagtaacttccgacttccacctaccagtcagaccaaccgtcctacgacgtccgtagtattacggttattttcgaccgtttaacttttacttacgtaccgaactaaacgtagttaataagttacgtttaacttaccggttaccgtttcccggaccggttacggaacctaggttgtacggaattacgtaaccgaaagtacgtgggtacgctacgacctaactacgttcttgtccttaccg

SEQ ID NO: 167465 - DNA, 647 bp, Homo sapiens
  misc_feature: GYAE6OF01EF1KM.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtctccttccaccctgtctgcatctgtcggagacagagtcacatcacgttcgccgggccagtcgagtaggttgttggtaccgtgggttcggcctggtatcgagacaacgaaaccgaggaaacgacccctaagcctccgtagatctatgatcgtctaccaagtagtagggaaacggtcgggtaccctagtacgtaaggtacgaggtcggacgtaggtgtacgtcgtagggaactagtaacgttacctactactccaaccgtatacacgaccgacgtcctaacgcgtccgtagtattgttagttttcgtacttacgtttaatttacgtacgtaaccctaagttaagtaagttaagttactttacgttaccgttaaaccgtttcggacccgttagggtacctaagtacggtaggtaacttaacgtaaaccgtaaacgtacgttcggtacggtctaacgtcctaaaccgttatccgttcgtcctttaaccg

SEQ ID NO: 167466 - DNA, 646 bp, Homo sapiens
  misc_feature: GYAE6OF01B67VW.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctcctccaccctgtctgcatcgtggtcggagacagagtccacatcaatggccggccagtccgagtagtgttggtactggtggccgtggtatcgagcaagaaccgaggaacgccctaacgtcctacgtgatctagtgatacgtcctacaatagtaggtaaagtcgggtaccatacgtaaggttacacggtcgacgtagtggtattcggaggactagtaaacttctacgtcgtaccaacgtactaccgtacgcgacgacccctacgtaccgccgttagtagttagttagtttcgtacgttaacttttatttaagttacgaaccgtaactaaagttaacgttaaagttacgtttaacgtttaccgttaaccgtttacccgggtaacccgttacggaacccgttaaggtacggtaggttaaactaacgtaacgtaaacgaacggttggtacggtcgttacgactacctatccgttcggttctttacccg

SEQ ID NO: 167467 - DNA, 857 bp, Homo sapiens
  misc_feature: GYAE6OF01E1FNN.16.81.H04.1.454.CMB.1.raw
  modified_base (844)..(844): a, c, t, g, unknown or other
  misc_feature (844)..(844): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatcgacccagtcctcccttccaccctgtctgcatcgtggtacggagacagagtccaccatcctacgttcggcccgggaccagtcgaggtaggttggtttcgggttaccgttggggttcggtcccgttagggttactccgaacggaccgtaaaacgggaaaacccggtaaagggggaaaacccggtaccccccgttaaaacggtcccttaaccccgtcggtaacttaccgttaagtacggtaactttacggttacccttaacccgtaaaagtttaagggtaacggggtaaaacggggttccggggtaacccctaaggttaccggtaaacgggttccgacggtccgggtaacgtaaggggttacgtacgtttaccgggtagggtaacctaaggttaaaccttaccgtaaccgttccttaccaacccgttagtcccaacgggtaccctaccggtacccttaaccgaccggttcccgtaagttaccgtttagtttacgtttttaggtaacgtttaacctttttaagttaaccgttaacgaacccttaaagtaacggtttaaagttaaacggtttactttaaccgttaccgttaaccgggtttcccggtacgttaacgggtaaccttaaggttcggtaagtaacgttacgtaaccgtaaacgtcgttggacgtaccctacgtaccgtacttccgttnttcgtcgttaccc

SEQ ID NO: 167468 - DNA, 669 bp, Homo sapiens
  misc_feature: GYAE6OF01DVHHX.16.81.H04.1.454.CMB.1.raw
  modified_base (148)..(148): a, c, t, g, unknown or other
  misc_feature (148)..(148): n is a, c, g, or t
  modified_base (294)..(294): a, c, t, g, unknown or other
  misc_feature (294)..(294): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
tcagtgtactactccacgaccggtgctcgatttagtagtgtagattcgcgggggtcagactcagtcaggacacagcatggacatggagggtccccgctcagcctccgtggggcctcctgctgctctggctcccaggtatacaaatgtnacatccagatcgacccagtcctccttcccacctgtctgctatctggtcgagacaggactccaccatccacttcggcccggacagtcagtaggttgttcgggtacctgggtcgtcctggtactcagcaacggaaaccgaggaaaccncccccgtaagcctccgtagacttactagtagtactcgttacctactaatacgtagggtaaaggtccggtaccagtacgtaacgtcgagcgtctaaggtcgtatcggtagganaacgtacttcacctcctaacacctatcgacnccgtaccgtactaacctgtccgtaagtattgggtttaacttttacggaccctttaatttacgttattaaccccggtaataaacgttaattaacgttaagggttacctttaacgttaccttaacccggttcggtaccccgtaggtaactaacgtgtaggtaattaaccggtaacgtaaaccggtaggtccgtagtccgacgtaccctaccgtatccgtttccgtctttacccg

SEQ ID NO: 167469 - DNA, 673 bp, Homo sapiens
  misc_feature: GYAE6OF01DAR25.16.81.H04.1.454.CMB.1.raw
  modified_base (197)..(197): a, c, t, g, unknown or other
  misc_feature (197)..(197): n is a, c, g, or t
  modified_base (398)..(398): a, c, t, g, unknown or other
  misc_feature (398)..(398): n is a, c, g, or t
tcagtgtactactccacgaccggtgctcgatttagtagtgtagattcgcgggggagtcagactcagtcaggacacagcatggacatgagggtcccgctcagctcctggggctcctgctgctctggctccaggtatcaaatgtgacatccagatcgacccagtctccttccaccttgtctgctatctgtcgagacagngtcaccatctacgttgccggcagtcaggtagtgttcggtacctggttggcctgggttactcgtagactaacggaaaaccgtagggaaaccgacccctaaagccttaccgtagtactcgtatgtactcgtacctacaatacgtaggaaacgtcgggtacccagtcgtaagttcaggtcgagtaggtagacgtacgacggaangtaacttcgacttccactacaagttccgagacctacgtaccaactcgaccgttagcttagttcgtttacgacgtacttttacgtttacgtaacgacctaaagtacgttaacgttaacggttactttactttaacgttaaccgtttacccggtaccgttacgggtaaacccttaaagttcgggtaacggtaagttaaccgtaactaaaaccgggtttaccgtacggttccggtacgttaccgaacccttacttaaccgttctttaccggtttaccc

SEQ ID NO: 167470 - DNA, 575 bp, Homo sapiens
  misc_feature: GYAE6OF01B3EUV.16.81.H04.1.454.CMB.1.raw
  modified_base (191)..(191): a, c, t, g, unknown or other
  misc_feature (191)..(191): n is a, c, g, or t
  modified_base (537)..(537): a, c, t, g, unknown or other
  misc_feature (537)..(537): n is a, c, g, or t
  modified_base (569)..(569): a, c, t, g, unknown or other
  misc_feature (569)..(569): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcgganacagagtccaccatcacttcggcccgggcagtcagaggttgttggtacctggttggcctggtatcagcaagaaaccgagggaaacgcccgtaagcctcctgatctatgatgtctacaatataggaaagtcgggtaccagtcgaaggttcaggcggcaggtgatcgtagggacagaattcactcgtaccactacgtacagccacgcctacgacgtcctagattcgtagtttcgacgttactttagtttacgttcaaccgtaactagtaagtaagttattaattacctacgtttccggacccgtagggaacctagtcggtagtatagttaaccgaaacgtaagttggngtcgtagacccgtacctattcttcgttccttntacccg

SEQ ID NO: 167471 - DNA, 798 bp, Homo sapiens
  misc_feature: GYAE6OF01B3VGK.16.81.H04.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagtgtactactccacgaccggtgctcgatttagtagtgtagattcgcgggggtcggactcagtcaggacacagcatggacatggagggtccccgctcacgctcctggggctcctgctgctctggcctccgaggtatcaaatgtgacatccagatcgacccagtcctccttccacctgtctgcatctggtcgaaganagagtcacctancacgttcgccggacagtcgagtaggttcgttcggtaccgttggtacggccgttaggtactacgacgacgaaacggaaaaaccgaaggggtaaaacctcccttaaaagtccgtaacccgttaggaacttacctaagtacgttaactcgtacccgttaaccgtaaagttaacggttaacgggtaaaacgggttccggggtaacccctaagttaaccggtaaacggttcgaacggtcggtaaccgtagggttacggacgttacggacggtaactaacggtaactttccgaccttactaaccgtaacctacgttaccgaacgtaccgaacgtaccctacgtacgcccgttagtaagttacgtttacgtttacgaaccgtttaactttaacgttataccgtaactaaacggtaattaacgttaaagtacgtttaccgttaacgtaccgttttaaccggaccccggttaaggtaacgtaacttaagggtactaaaacgttacgaaaaccggttacggttaaacggtcggtttccggaacgtacccgtaaccgtaaccttacgtacccgttacgtttaccctttccgttaacccg

SEQ ID NO: 167472 - DNA, 879 bp, Homo sapiens
  misc_feature: GYAE6OF01BQAEC.16.81.H04.1.454.CMB.1.raw
  modified_base (149)..(149): a, c, t, g, unknown or other
  misc_feature (149)..(149): n is a, c, g, or t
tcagtgtactactccacgaccggtgctcgatttagtagtgtagattcgcgggggtcagactcagtcaggacacagcatggacatggacgggtccccgctcagcctccgtggggctcctgctgctctggcctcccgaggtatcaaatgtnacatccagatcgaccctagtcctcccttcccacccttgtctgactatcgtggtcggagacagacgtcacctatccacgtcggcccggacagtcgaggtagttggttacggtaccgtgggttcggtcctaggtactcgacgacgaacggaaaccgaaggggaacccgtaccccgtaacgtccttaccgtagtactacgtagttacgtacttcgtacctaactaaggttacggtaagggtaaacgggttccgggtacctaagtacggtaacggtcgacggtacggacgtagggtcgtacggttacggaagggtaactaacggttacttaccgtaaccttaccaaccgtaaccgtataccggaacggaccctaccgtaacccgtaacacggtaccgttaggttacgtttaaccggtttgtttaccgggtaacctttaagttttaacgttaccggttaacccgtaaaccgttaaacgttaagtttaacggtttaaacgtttaccgttttaaccgtttaaaccccgggtttaaaccccggggtttttcccgggaaccccgggtttaaagggtaacccgtttaaaggggttacggtttaaaacccggtaaaccgttttaaaaaccggtaaaccccgttaaaacgggtttacggttacggggtacccgttaacgtacccggtaaacccttccggggtttaacctttccgtttaccggtttaccctttaaacccccgg

SEQ ID NO: 167473 - DNA, 685 bp, Homo sapiens
  misc_feature: GYAE6OF01DJMCY.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccggccagtcagagtgttggtacctggtggcctggtatcagacaagaaaccgagggaacgacccctaagcctcctgatactatgtatcgtctacctaatagtagggtaaacggtcgggtacccagtacgtaaggttcgacggcggacgtaggtggtagtcggtagggtaacaagtacttaccgacttacctaccaccctagtacaccgtacgaaccgtaccctacgtacgtcctagtacgttgttacgttttcggactttaactttacgtttagttacccgtaacctaaacggttaacgttaaagttaaggttaacgtttttaacgtttacccgttaaccggttttaccccgggaaccccggttacggggtaaaccttaaggttcggtaaggtaacttaaccgtaaacgtaaaccggtaagttcgggtacggtcctacggacctaacccgttatttcccgttgttccgtttaaccc

SEQ ID NO: 167474 - DNA, 698 bp, Homo sapiens
  misc_feature: GYAE6OF01BCXLV.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagacgtcacatcacttcgccggcagtcagagtgttggtacctggttcgcctggtatcgagacagaaaccaggaaacgcctaagctacctgactctatgtatcgtactacctaagtaagtaggtaaacggtcggggtaccctagtacgtaaggtcgaacggcgtcgaggtcggtagtcggtacggaacaagtaacttcacgtctacaccagtacacgacctacgtaccctaacgacgtccgtagtaacttggttactttagtacgttactttatttaacgtacgaaccgtaaacgtaacgttaacgttaaaggttaacgttttaaacgttacccgtttaaaccgttttacccgggaccccggttaacgggtaaaccctaagggttacgtaacggttaaactttaaacccggtaaaccgtaaaaccggtaaccgttacgggtacggttacccgtaacggtaccctaaacccgttaccgtttactttaccggttccttttaaaccccg

SEQ ID NO: 167475 - DNA, 660 bp, Homo sapiens
  misc_feature: GYAE6OF01A8TVG.16.81.H04.1.454.CMB.1.raw
  modified_base (277)..(277): a, c, t, g, unknown or other
  misc_feature (277)..(277): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagacgtcaccatcacgttgccggccagtcagagttgttcggtcctggttcggcctggtactcgagacaagaaaccgagggaacncccctaagcctactgtatctagtgatcgtcctactaatagtaggtaacggtcgggtaccagtacaaggttcgagcggcgagtggactcggtaggactagtactctactctacacgatccagaccgacgtacctacgacgtacctagtagtttacgtacgttttacggaccgttaattttacgtttacgtaaccgtaaccgtaaaactaggttaaacgttaaagttaccggttttaacttacccgttaacccggttttccccgggaacccgttaacggtaacccttaggttacggtaacggtaaccttaaggtaacccgtaaacggtacgttccggtagtacctacgtaccctaccgttaagttccctttgtacccgtttaccg

SEQ ID NO: 167476 - DNA, 810 bp, Homo sapiens
  misc_feature: GYAE6OF01BHQZ5.16.81.H04.1.454.CMB.1.raw
  modified_base (200)..(200): a, c, t, g, unknown or other
  misc_feature (200)..(200): n is a, c, g, or t
tcagtgtactactccacgaccggtgctcgatttagtagtgtagattcgcgggggtcagactcagtcaggacacagcatggacatgacgggtccccgctcagcctccgtggggctcctgctgctctggctcccaggtatcaaatgtgacatccagatcgaccagttcctcccttccaccctgtctgcatcgtggtcggganacgagagtccaccatcgacgtcggccggaccagtcaggtagttggttcggtaccgtggttcggtccgtaggtactcgacgacaaacggaaaccgaacggggaaaccctaccccgtaagccctaccgtacgtaacgtccgttaagtgtacgttacgtacctaaccgtaaaggttaaggtaacgggtaacgggttacccggggtaaccctaacggtaaccggtaacgggtttaccgacgggacggttacggaagggttacgggtaacgtaccgggtaagggaaaccaagtttaaaccgttaccttaacccggtacctaaccctaaccgttaaccgtacccgaacgggtacctaacccgtcccgttaaaacggccggttaaccgtagtaccgtttaagttcggtttaccgtaacggttttacttttaacgttacgttaaaccaaccggttaaagttaaacggtttaactaaacggtttacttttaaccgttacccggtttaaaccgggttcccgtacccgggtaagtaaccgttaaggtacggtacgtaacttaacgtaaccgtaaacgggtcttgacggttacacggtactacgtacttctcgttctaaccg

SEQ ID NO: 167477 - DNA, 621 bp, Homo sapiens
  misc_feature: GYAE6OF01AXR8Y.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcgccgggcagtcagagtgttggtacctggttggcctggtatcagcaagaaaccgagggaacgccctaagctctgatctatgtatcgttctacaatagtaggaaaggttcgggtaccagtacgaaggttcgaggcggacgaggtgagtcgtaggactagtaacttcgactctacacatcacgtcaacgtcctacacgtccctagacttgttatttacggacgtaacttttacgttatttaccgaacgtaacgtaagttaaacgttaaggttaacttttaacgttaccttaaccggtttaccggacccgttagggtaaccctaaggttcgtacgtaattaacgtaaacgtaaaccgtagtaggtacggtacgtacgtaccctaccgttacttaccttcgttaccttctaacccg

SEQ ID NO: 167478 - DNA, 700 bp, Homo sapiens
  misc_feature: GYAE6OF01D82T0.16.81.H04.1.454.CMB.1.raw
tcagtgtactactccacgaccggtgctcgatttagtagtgtagattcgcgggggtcggactcagtcaggacacagcatggacatgagggtccctgctcagctcctggggctcctgctgctctggctcccaggtatcaaatgtgacatccagatcgacccagtcctccttccaccctgtctgcatcctgtcggagacagacgtcacatcacgttcggccggcctagtcagtagttggttcggtaccgttggttggccttggtatcgagcaacgaaaaccgagggaaaccgccccgtaaagcctccgtagactcgtatgtactcgtacctacctaattagtaagggtaacggtcggggtaccctaagttccgtaaaggtttccgacggtccggacgtaaggtcggtaacgtccggtagggaactaagtaaacctttccaaccttcctaaccacctaacgtaccgacgtaccgaacggtaccctaaccggacgtcctaaggtacttaggtttacgtttcggtaaccttaacctttttaattacgtaaccgacccttaaaaggtaagttaagtaaacggttacgtttaactttaacccgtaaccgttttcccggacccgtagggtaaacctaggtcggtacgtaagtaccaaacgtaaacgacgttggacgtcacggacctaacgtatttcgtgttccttaccg

SEQ ID NO: 167479 - DNA, 773 bp, Homo sapiens
  misc_feature: GYAE6OF01D6BQJ.16.81.H04.1.454.CMB.1.raw
  modified_base (220)..(220): a, c, t, g, unknown or other
  misc_feature (220)..(220): n is a, c, g, or t
tcagtgtactactccacgaccggtgctcgatttagtagtgtagattcgcggggggtcagactcagtcaggacacagcagtggacatggacgggtccccgctcagctccgtggggctcctgctgctgtcggctccgtaggtatacaaagttggtacactacgtccgaagacgttaccgaccctacgttaccccttcccctttaccctacccttggttcccngtaccttacgttccggttagggtaccggaacgaacggaacggtactacccaaccgtacttaccgtaccggttccgggacccgtaccgtagtacgtacggtcggttcggtttacggtacggtttcgggtcgtcgttacggactacgacgaaccggaaacggaaccggaacgggacctacccgtatccgtactagtactactcggtatcgtactaccgtaataagtacggtaacgggttacggacggtacctaggtacggtaacggtcgacggtacgtggtaacggtcggtacgtcggaacgtacgtaactcgtaccgtactactaccacgtagaacgtaccacgtacctacgaacgtacgtgtaacgttgtttaacggtacgttttacgtaactttaccgttagttacctaaaccgtcgttaaaagtaacttagttaactacgttaacttacccgtaccggtacgtacggtaccgtaagttagtagtacgaacgttaaccaggtaccgtagccttcggaactcgtacctaagttcctaggtttcccattacccg

SEQ ID NO: 167480 - DNA, 761 bp, Homo sapiens
  misc_feature: GYAE6OF01COY15.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccgagatcgaaccctgtcctcccttccaccctgtctcgctactcgttcgacggagacaggactcaccatcctacgttcggccggccagtacgagtagttggttacggtaccgttgggttcgtccgtaggttactacgagaacgaaacggaaaaccggaagggaaaccctaccccgtaaagtcctccgtagtattacctaagtgtacttcgtaccgtactaagttaaggtagggtaaacggtttccgggaccctaagtacgtaacgggttacgcggtaccggtagtagggtacgtgtaacggtacgggaacttaaggtaaagttcaaacttccgtaacaaccgtgtaccgaacgacgtaacgaccctaacgcgtacctaggtaattgttaccgtttgaacttaacgttacttacgtacctaacgtaaacgtaagttaaacttaagtaaacgtttcgttaaacccttacgggtttaccccgtaacccggttacggtaaaccttaaggttacggttacgtaaagttaaaccgtaaaacgttaaacccgtaggttcgtaccgggtaccttaaccgggaccctaaacccgttattcccggttttagtccctttaacccg

SEQ ID NO: 167481 - DNA, 665 bp, Homo sapiens
  misc_feature: GYAE6OF01C9ZRA.16.81.H04.1.454.CMB.1.raw
  modified_base (275)..(275): a, c, t, g, unknown or other
  misc_feature (275)..(275): n is a, c, g, or t
  modified_base (406)..(406): a, c, t, g, unknown or other
  misc_feature (406)..(406): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacgttcggccggccagtcagagttgtggtacctgggtgcctggtatcgagcaagaaaccgaagggaaacnccccgtaagctcctgatctatgatcgtactactaagtagtagggtaaacggtcgggtacccagtacgtaaggttcgaggcggacgtaggtaggtatcggtagggactaagtacttacacgtctccaacctntaccagcacgtaccacacgtcctagtaagttgttacgttttcgaaccgtttaactttaagtttacgttacccgaaccttaaacgttaacgtaaacggtttaaagttaacgttttacctttaaccggttaaccggttttcccggaccggttacgggaaccttaaggttcggtaagtaacgttaccgttaaaacgaaacggttaggttcggtacggtaccgtaccgtaccgtaccctagtttccgttgtttccgttacccg

SEQ ID NO: 167482 - DNA, 698 bp, Homo sapiens
  misc_feature: GYAE6OF01B6ZB0.16.81.H04.1.454.CMB.1.raw
  modified_base (192)..(192): a, c, t, g, unknown or other
  misc_feature (192)..(192): n is a, c, g, or t
  modified_base (302)..(302): a, c, t, g, unknown or other
  misc_feature (302)..(302): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatcgacccagtctccttccaccctgtctgcatctgtcgganactagacgtcacatcacgttcggccggccagtcgagtagtgttcggacgttggtcgcgtggtatcgagacaacgaaaccgacgggaaacgccctaagtcctactagactntagtgtactcgtctaactaagtagtacgggtaaacggtcgggtaccctaagtacgtaacgggttcaacggtccggtacgtagggttggtacgttacggtaggaactaaggtaacttacctacgtaccgtaccaaaccgtactacgacgtaccacgacccttacgacgtctagtattcggtatttacgacgtttaacttagttacgtacccgaacgtaaaacgttaagttaagttaaacggtttacgttaaaccgtttccgttaaaccggttccggacccggttaaggtaaccgtaacgttgggtaacgtaactaacgtaaaccgtaaacgtaccgttggtaccggtactaccggtaccttaactcgtttaaccttcgttacccttccgttaacccg

SEQ ID NO: 167483 - DNA, 606 bp, Homo sapiens
  misc_feature: GYAE6OF01EQ51G.16.81.H04.1.454.CMB.1.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
  modified_base (476)..(476): a, c, t, g, unknown or other
  misc_feature (476)..(476): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatcgacccagtcctccttccaccctgtcctgcatctgtcgganacagagtccaccatcacgttcggcccgggcctagtcaggtagttggttacggtaccgtgggttcggccttgggtatcgagacaacggaaaccgaagggaaacncccctaagccttaccgtgactctagtcgattcgtacctactaatgaaggtaaggtcggtaccagtacgagttcaggcgacgaggtgactcggaggactaacggtaattccactcaccgacactcacgacacgcctacacgtctaagtacgtttgttaacgtttgaccgttaactttnttactacgaacctaagtaagtaacttaagttagtttaacttacgttaacgttccggaccgttaggaaccttagtcgtagtactacgtaacgaaactggtagtacgacgtacgactactcttgttccttac

SEQ ID NO: 167484 - DNA, 686 bp, Homo sapiens
  misc_feature: GYAE6OF01D6O3M.16.81.H04.1.454.CMB.1.raw
  modified_base (426)..(426): a, c, t, g, unknown or other
  misc_feature (426)..(426): n is a, c, g, or t
  modified_base (605)..(605): a, c, t, g, unknown or other
  misc_feature (605)..(605): n is a, c, g, or t
  modified_base (666)..(666): a, c, t, g, unknown or other
  misc_feature (666)..(666): n is a, c, g, or t
tcagtgtactactccacgaccggtgctcgattttagtagtgtagattcgcgggggtcagactcagtcaggacacagcatggacatgagggtccccgctcagctcctggggctcctgctgctctggctcccaggtatcaaatgtgacatccagatcgacccagtctcccttcccacctgtctgctatcgtgtcggagacgagctccacctatcgtacgtcggccggacagtcgagtagttcgttacggtaccgttgggtcgtccgttggtactcgaacgaccgaaacgaaaccggaaggaaacccgtccccctaaggtccttaccgtagtactttcgtagtgtacttcgtacctaactaagtagggtaacgggtaaccggtccgggtaacctaacgtttacgaacggttcggaacggccggtaacgnggtacggtacgttcggaaacgggtacttagtacctctaacttccctaacactacgcacgaccgtcacctacgcctgtacgtattagtttcgttcgtaacgtttattttaactcgtaccaacttaacgtaattaacgtaagttttactacggtttaccttccggtcggtaccgtaaggtntaacgttggtaataacgttaactaaccggttaaggtgtcggtactcgacccgtactacttnttacctttcgtacttacccg

SEQ ID NO: 167485 - DNA, 738 bp, Homo sapiens
  misc_feature: GYAE6OF01BFK2A.16.81.H04.1.454.CMB.1.raw
tcagtgtactactccacgaccggtgctcgatttagtagtgtagattcgcgggggtcagactcagtcaggacacagcatggacatgacgggtccccgctcagctccgtggggctcctgctgctctcggctcccgaggtatacaaatgtgacatccagatcgaccctagttccttcccttcccacccttgtctcgctactcgtggtcggagacagacgtccacctatacctacgttcggcccgggtacctagtaccgtagggtaggtttcggtttacgggttaccgttcggggttcgggtcccgtttaggtaacgttacgaacggaccgtaaaaccggaaaacccggaacgggggtaaaccctaccccgtaacgtcccgttaccgtaggtacttacgttagtgtacgttaccgtactacaaggttaggacgggtaaacggtccggtacctagttacggaagtcggacgcggtacgtaggtggactcggtacggactaagtacttccacgtcctacactactcacgtccgtaaccgctacgtactacgttagtacgtttagttctttaccgtacgtttactttagttacgactaacctaagttaagttaacgttaacgtttactttaacgtaccgttaccggttccggtaccgtagtaaccgtaggtcgtagtaaacttcgaaaccggtaagtcggttgtaccgtacaccgttacctcgtacttcgttcgttccttaaccg

SEQ ID NO: 167486 - DNA, 728 bp, Homo sapiens
  misc_feature: GYAE6OF01EO18U.16.81.H04.1.454.CMB.1.raw
  modified_base (703)..(703): a, c, t, g, unknown or other
  misc_feature (703)..(703): n is a, c, g, or t
tcagtgtactactccacgaccggtgctcgatttagtagtgtagattcgcggggggtcagactcagtcaggacacagcatggacatggagggtccccgctcagctcctggggctcctgctgctctggctcccaggtatacaaatgtgacatccagatcgacccagtccttcccttcccaccctgtctgcatcgtcggtcggagacagacgtccaaccactctaaccgttcggcccgggacctaggtacgaggtaggttgtttcgggttaccgttgggttcggccgttaggttactcgacgacgaaacggaaaaccggaaggggaaaccgacccctaacggccttaccgtagtactacgtagtgtacttcgtaccgtactaagttaaggtagggtaacgggtcgggtacctagtacgtaacggtacgaggcggagaggtggagtcggtaaggactagtactacctactacctacctactacgacacgacaacgtaccctacgcgttaccgtagtacttaggttagtttacgactttactttacgtacttacgaacctaataagtttaataagtttacgttacttacccggttaaccgtttccgggtaacccgaggggttaaaccctagggttacgttaacgtaaacgttaacgtaaaccggaaagttaccgggtggtaccggtacttaccggaacccttaacttnttacccgggttacttccgttacccg

SEQ ID NO: 167487 - DNA, 672 bp, Homo sapiens
  misc_feature: GYAE6OF01ESX17.16.81.H04.1.454.CMB.1.raw
  modified_base (667)..(667): a, c, t, g, unknown or other
  misc_feature (667)..(667): n is a, c, g, or t
tcagtgtactactccacgaccggtgctcgatttagtagtgtagattcgcggggggtcggactcagtcaggacacagcatggacatggagggtccccgctcagctccgtgggggctcctgctgctctggcctccaggtatacaaatgtgactactccagatcgacccacgttcctcccttccacccttgtctcgcatcgtggtcggagacagacgtccacctatcctacgttcggccgggccagtacgaggtagttcggttcggttacgttgggttcggtccgtaggtactcgaagaccgaaacggaaaacccggaacgggaaaccgtacccgtaacggtcccttaccgttagtacttacgtagtacgttacgttcggtacctaactaaggtaggtaacgggtaacggtcgggtaccctaagtacgtaggtcggacggcggtagtaggtggtacgtcggtaggaactagtaacgttcctaaccttccgacctacgactacgacaccgtacgacctacgcgtctagtacttagttacgtttcgactttattactatacgtactaagtattaagttacttagttactacgtacgttccgacgtagtacgtagtcgtacgtactacttaacgacgttggcgtcggtctacgacttactcttacgtcttctntaccg

SEQ ID NO: 167488 - DNA, 652 bp, Homo sapiens
  misc_feature: GYAE6OF01EEOKI.16.81.H04.1.454.CMB.1.raw
  modified_base (196)..(196): a, c, t, g, unknown or other
  misc_feature (196)..(196): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (480)..(480): a, c, t, g, unknown or other
  misc_feature (480)..(480): n is a, c, g, or t
  modified_base (513)..(513): a, c, t, g, unknown or other
  misc_feature (513)..(513): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatcgaccctagtctccttccaccctgtctgctatcgtgtcgganacagacgtccacatctacgttcggccggacagtcgagtgttggttcggtacgttgggttcggtccgtaggtactacgagacgaaacggaaaacccgaacggggtaaaccacccccgtaacggccttaccgtagtaactaccgttatgtacgttcgtacctacgtaaagtagtacgggtaaaggtccgggtacctattacggtagtcgacggcgngagtgacgtggtacgganaagtatccaactcacaccatcacgcacgtacctacgacgtctagtacgtttntacgtttacgacgttttattacgtttaccgtanaacccgtaattaagttaaggtaactttacgtttactaaccgtttaccgtccggtacccgtacggtaacttagtaggttacgtaataacgtaacgtaacgttagtgtacggatccgtactacgttattcttgtccttacg

SEQ ID NO: 167489 - DNA, 601 bp, Homo sapiens
  misc_feature: GYAE6OF01CKAVN.16.81.H04.1.454.CMB.1.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (408)..(408): a, c, t, g, unknown or other
  misc_feature (408)..(408): n is a, c, g, or t
  modified_base (581)..(581): a, c, t, g, unknown or other
  misc_feature (581)..(581): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccctccaccctgtctgcatctgtcgganacagatcaccatcaagttcgccggcagtcagagttgtcggtaccgtggttcgccgttggtactcgagacaacgaaaccgagggaaaccnccctagcctctagtatctatgacttcgtactacctaatagtacggaaaggttccgggtaccagtacgtaaggttcgacgcggacgtaggtgtagtcggtacggacaagtactcactctacacgtancagacacgtaccacacgtcctagtattgtatttacgacgttaatttagtacttcgaactaaacgtagtaattaagttagtttactaccgttaaccgttccgaccgtaggaacctagttcggtacgtaattaacgtaactaaacggcgtttgacggacgttacgaccctacgtntttccgtcgttcttaccccg

SEQ ID NO: 167490 - DNA, 701 bp, Homo sapiens
  misc_feature: GYAE6OF01C4B71.16.81.H04.1.454.CMB.1.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (479)..(479): a, c, t, g, unknown or other
  misc_feature (479)..(479): n is a, c, g, or t
tcagtgtactactccacgaccggtgctcgatttagtagtgtagattcgcgggggtcagactcagtcaggacacagcatggacatgagggtccccgctcagctccgtggggctcctgctgctctgctcccaggtatcaaatgtgacatccagatcgaccctagtctcctccacctgtctgcatcgngtcgagacagagtcacntctactcgaccggccagtacgagtgtgttcggtaccgttggtcgtcgttgtactcganaccgaaagaaaaccgaaggaaaccgacccctaaagcctacctaggtaacttacgtagtcgaattcgtactaccgtaaagtggtaagggtaacggtaccgggtaccctaaggtaccgtaaggtacgacggcggtacgtaaggtcgtacgttacggaaggaacgtaacggtactttacaacctttcaacctacacgacgacaccgttacgaccttaaccgngtaccgtaagtaagttacgttacgtttcgtaacgtttaattacgttataccggaacctaaagtaacggttaataacggttaactttagttaaccggtaccgttcccgtaaccgtaggtaacctaaaggttccgaaaggtaactacgggtaaacctaaacgggtcgttaagggtacgtccgaacgtacccctaacttgtttacccgttgtttcccctaaaggg

SEQ ID NO: 167491 - DNA, 678 bp, Homo sapiens
  misc_feature: GYAE6OF01EC4YS.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacgttcgccgggccagtcaggtagttgttacggtaccgtggttcggtcctggtatcgagtaccgaagaaaaccgagggaaaccgtccccctaagtccttacgtacgtattaccgtatcgtagttcgtacttacctaagttagtacgggtaaagggtcggtacctagttacgtaaggttcaacgggcgtacgtaaggtggtacgttacggtagggtaactaaggtaactttaccgacgttacctacctaaccacttacgaccggtacacggtaccctaacgtacgtaccgtagtacgttacgttactttcgacgttactttatttacgttaacgaccgtaagtaacgtaacgttaagtacgtttacttaccgttaacccgtttccggacccgttaggtaaccctagttcggtaagtaacgtactaacgaacggtaagtcggtacgactcgacctactactcgtcgttacccg

SEQ ID NO: 167492 - DNA, 649 bp, Homo sapiens
  misc_feature: GYAE6OF01EEGRH.16.81.H04.1.454.CMB.1.raw
  modified_base (269)..(269): a, c, t, g, unknown or other
  misc_feature (269)..(269): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctccaggtatcaaatgtgacatccagatgacccagtcctccttccaccctgtctgcatctgtcggagacagatccacatcacgttcggccggcagtcagtagtgttcggtactggtgctggtatcagcaagaaaccgaggaaacnccctaagcctcctagatctagtgtatcgtactacaatagtaggaaggtcgggtaccagtacgtaagtcgaggcgcgtagtggtactcgtacgggaactagtaacttaccacttccactaaccgtaactacgacgaccaacggtcctaacgacgtcctagtaacgtttagttacgttttacgacgtttaactttaagtttactaacggtacctaaacgtagttaacgttaaaagtctttaaacgttccgttaaaccgtttccgggacccggttaacggaaccttaagttcgggtaagtacttaaacgttaaccgaaacgtaacggtttcggagttaccgtactaccggtacttaacgttccgttcgtttacctcttacccg

SEQ ID NO: 167493 - DNA, 719 bp, Homo sapiens
  misc_feature: GYAE6OF01B7L1A.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagttcctccttccaccctgtctgcatcgtgtcggagacaggtagtccaaccatcctacgttcggccgggccagtccgagagttgttcggtacttgggttcgccttaggtactcgacgaccgtaaacggaaaacccggagggaaaccgtaccccctaaaggccttacccgtaggtacttaccgtagtacgtacgtttccgtaccgtaacctaagtaacggtaggggtaaacggtccgggttaccccaattacggtaacggttacgacggtcggtacgtagggtgtacgtcgtaagggacctaagtactccactcctaccgaacatacgacgaccgtaacgacctaacgtctacgtgtacgttacgttagtttaccgactttacgttattaccgttcaaccgtaacgttaagtaagtttaacgtaacgttttacgttaacccgtttaacccgttccggtacccgttaaggaacccttaggtgttaccggtaattaccgtaacgtaaccggtagttcggtaccgtacgtccgacttaaccgtgttacctcgttacgttaaccg

SEQ ID NO: 167494 - DNA, 890 bp, Homo sapiens
  misc_feature: GYAE6OF01BXQ5J.16.81.H04.1.454.CMB.1.raw
  modified_base (210)..(210): a, c, t, g, unknown or other
  misc_feature (210)..(210): n is a, c, g, or t
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
tcagtgtactactccacgaccggtgctcgatttagtagtgtagattcgcgggggtcagactcagtcaggacacagcatggacatgacgggtccccgctcagcctccgtggggctcctgctgctctcggctcccgaggtatacaaatgtgacactaccagacgtcgacctagtcctcccttccaccgtgtctgctagtcgtcggtacgganacgagactacacctactcgtacgtccgggccggactacgtacgtaggtacgttggttacggtaccggttgggtacgtccgtgtacncgtagaaccgaaacggaaaccggtaacgggaaaccgtaccccgtaagtcctcgtaagtctacgtntacgtacttcgtactaaccgtaagtaacggtaacgggtaaccggttacgggtaccctaaaggtaccggtaacggttaccggacggtacgacggtaacgggtgtaacgtaccgggtaaggtaacgtaaacgttaccctttagtaaccccgtacgtaaccctaaccggtaacgttacgaacccgggtaaccctaccggttaaccctaaacgggtaccgttaaccggttaacggttagtttaaccggtttttacgtttacgttaaaccgtttaactttttaacgtaccggtttaaacgtaaaccttaaaccgggttaaaggttttaaccgtttaaaaacgggtttaaccttttaacgggtaacccggtttttaaccccggtaaccccgggttaaccggtttaaacccggtaaggttaaacttacggggtaaacgttaaacctaaacccggttaagttaaaacgggtccggttccgggaactaacgggttccctaaacgttacgttaactttcggttacgtttaacccttacc

SEQ ID NO: 167495 - DNA, 761 bp, Homo sapiens
  misc_feature: GYAE6OF01ATBC1.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctccaggtatcaaatgtgacatccagatcgacccagtctccttccacctgtctgcatctgtcggagacagagtcacctatcacgttcggccgggtcagtcgagtacgttggttacggtaccttgggttcggccttggtactcgaggcaaggaaaccgagggaaacctcccctaaagcctaccgtgacttctaagtgtactcgtacctacaagttagtacgggtaaaggtcgggtaccaagtacgtaaggttcgacggcggacgtacggtggacttcggacggaactagtaacttcccaacttcgtaccaccgtacgtacgaccccgagtaccgtccgtaacgtcgtacgttacgtaatttggtttaacgttttccggaaccgtttaacttttaaacgttacgttaccgaaccgttaaacgtaaggttttaaattaaacggtttaacgtttttaaccgtttaaccggttaaacccggttttcccgggtaacccgttaacggggtaaccttaaaggtttacgggtaacgggttaaacttaacccgttaaccggtaaaaccgttagggttacggtaccggttaccgtacgtaccccgttaaaccgttgtttaccctcgtttacccgttcgtttaaccccg

SEQ ID NO: 167496 - DNA, 748 bp, Homo sapiens
  misc_feature: GYAE6OF01CSO73.16.81.H04.1.454.CMB.1.raw
tcagtgtactactccacgaccggtgctcgatttagtagtgtagattcgcgggggtcggactcagtcaggacacagcatggacatgagggtccccgctcagctccgtggggctcctgctgctctggctcccaggtatcaaatgtgacatccagatcgacccagtcctccttccaccctgtctgctatcgtggtcggagacagacgtccacctatccacgttcggcccgggccagtcaggtagttcggttacggtaccgtgggttcggccttaggtactcgagacgaaaccggaaaaccggaacgggtaaaccgaccccgtaagccgtacctagtacttacgttagtacgtacttcgtacctaaccgtaagttaaggtaaggggtaaaccgggtttccgggtaccctaagtacggtaacggttcgaacgggtcggacgtacgggttaggacgttacggagggtacaagttaaccttcctactcctacctaacctacgtaccaacggtacctaaccggtccctaacgtacgtacccgttaggtaacgtttagttacgttttcgaccgttttaaagtttacttacgttaccgaaacctaacgttaagttaaacgttaagttaactttaacggtttaccccgttaacggtttcccggacccgttaaggtacctaagttacgtagtaactacgtaaacgtaaccggtagtcggtcggtactacggacctactagttctacgtccttcgtacccg

SEQ ID NO: 167497 - DNA, 823 bp, Homo sapiens
  misc_feature: GYAE6OF01DHV19.16.81.H04.1.454.CMB.1.raw
  modified_base (176)..(176): a, c, t, g, unknown or other
  misc_feature (176)..(176): n is a, c, g, or t
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
tcagtgtactactccacgaccggtgctcgatttagtagtgtagattcgcgggggtcagactcagtcaggacacagcatggacatggagggtccccgctcagctccgtggggctcctgctgctctggctcccaggtatcaaagtgtgacatccgagatcgaccagtcctaccttccncctgtcngctatcgtgtacggganacagacgtcacctactacgtacgttcgggccggacctagtacgaggtagttcggttacgggtaccgttgggtcggtccgttagtacgtcgagtacaaacggaaaccggaagggtaaccgacccctaagtccctaccgtagtaacttctaagtcgtacgtcgtacctaacgtaagttacggtaagggtaacggtcgggtacctaggtacgtaggtacgacggtccgtagtaacgggtggtaacggtcgggtaacgggtaactaacggtacgttaccgtaccttacttaccgaaccgttaccgtaacgacgtacccgtaacgtaccctaaacgtcggtacctaggttaacggtagttttaaccggttacgtaaaccgtttactttaacggtttaacgttaccaacggttaaattaagggtttaaataaccggttttaaggtttaccccttttaacgggttacccgggttttaacccggtaccccggttaaggttaaccgtaacgggtttaggtaaacgggttaactaaacgttaaaccgggtaaacggttacggtttacgggaccggttacccgtacgtaacccggttaaccttaggtttcccggtaacccttcgtttaaccccg

SEQ ID NO: 167498 - DNA, 640 bp, Homo sapiens
  misc_feature: GYAE6OF01BTAYW.16.81.H04.1.454.CMB.1.raw
  modified_base (293)..(293): a, c, t, g, unknown or other
  misc_feature (293)..(293): n is a, c, g, or t
  modified_base (368)..(368): a, c, t, g, unknown or other
  misc_feature (368)..(368): n is a, c, g, or t
tcagtgtactactccacgaccggtgctcgatttagtagtgtagattcgcggggggagtcagactcagtcaggacacagcatggacatgagggtccccgctcagctcctggggctcctgctgctctggcctcccaggtatcaaatgtgacatccagatgacccagtcctcccttccacccctgtcctgcatctgtacggagaccagatcaccatcacgttggcccgggcagtcagtagttggttggtaccgtggttcggccgttggtatcgagcaacggaaaccgaggggaacnccccgtaagcctctgacttctatgatcgtcctacaagtagtaggaacggtcggtaccagtcgaggtcgacggcgngaggtgactcggaggacagacttcacctctacactacgtcacgcgacgactacgacgtccagtacgttcgttcgtttacgaccgttttacttaagtttacgttacgaccgttaaactaaggttaaacttaaggttaactttaaccgtttaacgttaaccccgtttccgggacccgttaccggtaaacgttagtacggtacgtaacgttacgtaacgtaaacggttacggtggtaccggcgttacggaccctacgtacttccgttcgttaccc

SEQ ID NO: 167499 - DNA, 900 bp, Homo sapiens
  misc_feature: GYAE6OF01D20RT.16.81.H04.1.454.CMB.1.raw
tcagtgtactactccacgaccggtgctcgattttagtagtgtagattcgcgggggtcagactcagtcaggacacagcatggacatgagggtccccgctcagctcctggggctcctgctgctctggctcccaggtatcaaatgtgacatccagatcgacccagtcctcccttcccaccctgtctgcatcgtgtacggagacgagacgtcaccatcacgttcgccggaccagtcaggtacgttggtttacggtaccgttgggttcggtccgttaggtactacgtacgaccgaaacggaaaacccgaacggggaaaccgaccccccgttaaagtacccttacccgttacggtactttacgtaaggtttacgtagtttacgttacccgtaacctaaagttaaggttaagggtaaaaccggggtttcggggttacccctaaagttaaccggttaaacgggttccgaacgggtaccggtaccggtaagggttacgggtaacgttccgggtaaacggggtaaactaacgggttaaactttcccgtaaacccgttacccgttacctaacccgtaagttaacccgaaggtcccgtaaaccggtacccttaacccggtacgttacccgtagttactttaacggttttaccgttttacgtttaacccttaaatttttaacggttttaaccttaacccgggtaaacctaacggtttaaagtaaacccggttttaaaaggttacgtttttaaaccgtttaaacccgtttaaccggttttccccggaaccccggttacgggtaaacccgtagttacggggtaacgttaaacgttaaaccgttaaacggtaaacccggtaaggttggacccgttaggttaccaaccgtacgttacttccgtgtttacccttaccg

SEQ ID NO: 167500 - DNA, 805 bp, Homo sapiens
  misc_feature: GYAE6OF01DOGLF.16.81.H04.1.454.CMB.1.raw
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatcgaccctagtcctccttccaccctgtctgctatctggtacggagacgagtacgtccaaccataccgtacgttcggtaccgggacctagtacgtaggtaggttcggtttcggttaccgttggggttaccggtcctaggtactcggaagaaccgaaacggaaaacccggaggggaaaccctccccctaaaggtccccttccggtaagtaccgtttactaagtcggtaacgtttcggtaaccttaccgtaaaagttcgggttaaagggtaaaccgggtttccgggtccctaagtaccggtaaaggttccgaacggtcggtacgtaagggttcgaaggttcggtaaacgggaacttaaacggttaccttactaccgttcctaacccgtaaccttacgtaaccgtaacgtccccgtaaaccggtacctaaccggtacggtccgttaagtacgttacgtttacgttttaccggtaacctttaacgtttacgtttaacgtacgtaacccgttaaagttaacgtttaaagtttaacggttaacgttttaccgttaacgttacccgtttaccggacccgttacggtactaggttacgtacgtagtaacgtaacgtaaacgttcggtacgtcgtctaggcctacgtattcgcgtttctacg

SEQ ID NO: 167501 - DNA, 756 bp, Homo sapiens
  misc_feature: GYAE6OF01ELC46.16.81.H04.1.454.CMB.1.raw
  modified_base (715)..(715): a, c, t, g, unknown or other
  misc_feature (715)..(715): n is a, c, g, or t
  modified_base (729)..(729): a, c, t, g, unknown or other
  misc_feature (729)..(729): n is a, c, g, or t
tcagtgtactactccacgaccggtgctcgatttagtagtgtagattcgcgggggtcagactcagtcaggacacagcatggacatgacgggtccccgctcagctcctggggctcctgctgctctggctcccgaggtatcaaatgtgacatccagatcgaccctagtccttcccttccaccctgtctcgctatcgtgtcggacgacagaacgtaacctctccgtacgttcggccggcctaagtcgacggtaggttcggtttaccggttacgttgggttcggtccgttaggtacgtacgaacgacgaaacggaaaaccggaacggggtaaacctaccccgttaagtccgttaccgtagtacttacgtagtacgtacgttccgtaccttaaccgtaaagtacggtaacgggtaaaccggggttccgggtaaccgttaacgttaacggtaacgggttaccgaacggggtaccggtacggttaacgggtacggtacggttaccggtacggggtaaacctaacggttaaccttacccgtaaccttaccgtacctaccgtacgtaacaaccggtaccaacggtaccctaacgtaccgtcgtagttaacgttgttacgtttatacgtttatttacgtactacgtactaagtattaacgtaagttacttacgttaccgtacgttccgacgtaggtactagtagtacgtactaagtaccgtaagtntacggctacgtacncttactagttacttcgttctcgtcccg

SEQ ID NO: 167502 - DNA, 808 bp, Homo sapiens
  misc_feature: GYAE6OF01DKDSG.16.81.H04.1.454.CMB.1.raw
  modified_base (790)..(790): a, c, t, g, unknown or other
  misc_feature (790)..(790): n is a, c, g, or t
tcagtgtactactccacgaccggtgctcgatttagtagtgtagattcgcgggggtcagactcagtcaggacacagcatggacatggacgggtccccgctcagcctccgtggggctcctgctgctctcggctcccgaggtatacaaatgtgacactccagatcgaccctacgttccttcccttcccacccgttgtcctgacctacttcggttcggtacggaacgaccgaggtacctaccaaccgtacttaccgttaccggttccgggcccgggtacctaacggtaccgaagggttcgggtttacgggtttaccgggttaccggtttcgggggtttccggtacccggttagggttacttaccggaacggaacccggtaaaacgggaaaacccggtaaaccggggtaaacccgtacccccgtaagtcccgttacgtacgtacttacgtagtcgtactactactaactaagtaggtagggtaacggtcggtacctagtacgtagtcgacggcgagtaggtacgtcggtacgacggtaactaacttacctcgtactcctacctaccgtacgacgaccgtaccgaacgtacctacgtcgtcgttaagtacgtttgttacgttacgtacgtttattacgtacgtacgtaaacgtaagttaacgtttacgtaaagtttaccgttttaaccttaccggtttaacccgggttccgttaacccgggtagttaaccgtggttaccgtaagtaaccttaacggaaccggttaagtacgttcggacgtacctcgactaccgttnttacccttgtccgttccg

SEQ ID NO: 167503 - DNA, 707 bp, Homo sapiens
  misc_feature: GYAE6OF01C055E.16.81.H04.1.454.CMB.1.raw
  modified_base (169)..(169): a, c, t, g, unknown or other
  misc_feature (169)..(169): n is a, c, g, or t
tcagtgtactactccacgaccggtgctcgatttagtagtgtagattcgcgggggcaggagtcagactcagtcaggacacagcatggacatggacggtcccgctcagtctcctggggctcctgctgctctggcctcccgaggtatcaaatgtgacatccagatcgaaccngtcctccctccacctgtctcgctactcgtggaccggagaacgacggaccgttaccactactacgtaccgttcgggcccggactacggtacaaggtacggtttacggttcggttaaccgttgggtaccggcggttacggttacaccgacggaaccgaacggaaaacccggaacggggaaaccctacccccgttaaagcccgttacgtagtacctagttagacggttctacgtaccaacgttaagtacggtagggaacggttccgggacctaagttacggaacgttcgaggccgtagacggtggactcgggaggtacaagtactacactcacgacacgtcacgcacgtctacgactcgtagttattcgtagttcggtactttatactttacgacgtaacctaagtaaccggttagttaagtacgtttacttaacccggtggttaccccggaacggtttacgagttaggtacgaacgttaacgttaaccgaaacgtaacgggttgtacgttacggacctacacccgttattaccgtttccg

SEQ ID NO: 167504 - DNA, 783 bp, Homo sapiens
  misc_feature: GYAE6OF01ASN6V.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctccaggtatcaaatgtgacatccagactcgacccagttcctacccttccaccctgtctgcatcgtgtccggatacgagacgtccacctatctacgttcggccgggtccagtcaggtagttcggttcggttaccgtggggttcggccgttagggtactacgacggaaccggaaacggtaaaaccggaacggggtaaaacccgtaccccgtaacggtacccttccgtaggtacttacctagtcgtaacttcgtaccctacgtaaagttacggtagggtaaacggtccgggtacctaatacggtaacggttcgaccggtaggcgtaacggtggacttaccgggaggaactaaggttaactccgtaccttacgaccaccgtagtaccgaacgaccgtacgtaacctacggtacccgtaccggttataacgtttaggtaacgtttttcgtaacgttacgtttttaactaccgttaacgaacccttaagttaacgtaacgtttaacgttaacgttttaactaccccggtttacggttacccgggaccgttaacggttaacgtaggttggaaccggttaaacttacgtaaaccggtaagttcggttaccggagttacccgtaacccgacctaccgtttatttccggtaactttccccgtacccg

SEQ ID NO: 167505 - DNA, 820 bp, Homo sapiens
  misc_feature: GYAE6OF01EEONW.16.81.H04.1.454.CMB.1.raw
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatacgacccagtcctcccttcccacccttgtctgcattcgtggtcggacgacgagacgtccaccatccgtaccgttcggccgggccagtaccgaggtaggttcggtttacgggttaccgttggggttacggtccgttaggtactacgagaccgaaacggaaaaccggaacggggtaaaccctccccgtaaggtccccttaccgtaggtaactttactaggttacggtacttcggttacccttaacgtaaggttagggtaacgggtaacggtccgggtacctaagtttaccggtaacggttcgaacggtcggtacgtagggttgtacgttccggaaaggtacctaaacgttaccttaccgtaccgtaccttacccgaacctacgtaccgacccggaccgtaccgtacgtaaccgccgtacgtagtacgtttacgtttaccgtttacgttaccgtttaacttttagttacccgtacgttaaacccgtaaagtaacgtttaaagtttaacggtacttttaaccgttaacccgttttaccggtacccggttaaccggtaccggttaactagggtttacggtaaccaaacgtttacggtaaacccgttaaagggttcggttacgggcggtacctacggtaccttacggttcttcgtttaccgtccttaacccg

SEQ ID NO: 167506 - DNA, 632 bp, Homo sapiens
  misc_feature: GYAE6OF01D766T.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgcatctgtcggagacagagtcaccatcacttgccggcagtcagagtgttgtactggttgctggtatcagcaagaaaccgaggaacgcccctaagcctctagtatactatgatcgtactacaatagtaggaaaggtcggggtaccctaagtcgtaacggttacgacggacggtaccgtagggtaggactcggtagggaactaaggtaacttccacttactaccacctatacgaacgtaccaacgtaccgtaacgtacgtcctagtactttacgtagttttacggaacgttaacttttagttacgttacgacctaaacgtaagttaagttaacgttacgtttaacttacccgttaacgtttcccggacccgttaggtaaccgtaattggtacgtaaattacgtaacgtaaacgtacgttggtacgcgtacgtaccacctaattcttcgtccttaccg

SEQ ID NO: 167507 - DNA, 655 bp, Homo sapiens
  misc_feature: GYAE6OF01EXLGN.16.81.H04.1.454.CMB.1.raw
  modified_base (145)..(145): a, c, t, g, unknown or other
  misc_feature (145)..(145): n is a, c, g, or t
  modified_base (231)..(231): a, c, t, g, unknown or other
  misc_feature (231)..(231): n is a, c, g, or t
  modified_base (372)..(372): a, c, t, g, unknown or other
  misc_feature (372)..(372): n is a, c, g, or t
tcagtgtactactccacgaccggtgctcgatttagtagtgtagattcgcggggggtcagactcagtcaggacacagcatggacatgagggtccccgctcagctccgtggggctcctgctgctctggctcccaggtatcaaatgtnacatccagatcgacccagtcctcccttcccacctgtctgcatcgtgtcggagacagacgtcaccatcacgtcggccggcagtcagngtgttgtaccgtggtcgctggtactcagacaaggaaaccgaggaaccgacccctaagtcctaccgtagtataccgtagtggtactcgtacctactaagtagtacggtaacgggtcggtaacctagtacgtaagtcgacggngtacgaggtacggtactaggtagggtaaccaagttaacccgtactccgtacctaccgtaaccgtacgttaccgacggtacctaaccgtacccgttaacgacgttacctaaggtatttacgttagttttacgtacttaacgtttaattcgttaacgacctaagtaacgttaagttaagttcctttaagttaccgtacgtttccggacgtacggacttagtagtagttaactaacgacgtaaagtaccgtgtactacgtacacgttctacttctccgtctacccg

SEQ ID NO: 167508 - DNA, 594 bp, Homo sapiens
  misc_feature: GYAE6OF01BB51S.16.81.H04.1.454.CMB.1.raw
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
  modified_base (577)..(577): a, c, t, g, unknown or other
  misc_feature (577)..(577): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagacgtcaccatcacttggcccggcagtcagtagtgtggtacctggttggcctggtatcagcgaagaaccgaggggaacnccccgtaagcctacctgatctatgatgtcactagtagtaggaaggtcgggacctagtcgtaacggttcaaggcggtnaggtcggtatcggtcggtacagtactcaactctacactataccgagacacggtcctagacgtcctagtaacttggtatttcggtacgttactttagttacttcgaacctaagtaacgttaataacgtagttaccttacgtacccggtttccggaccgttacgggtaacctagttaggttagtaaaccttagtaccgtaaagtacggtggtacgcgttcaccgtactntcttcgttacttacccg

SEQ ID NO: 167509 - DNA, 798 bp, Homo sapiens
  misc_feature: GYAE6OF01DKCCX.16.81.H04.1.454.CMB.1.raw
  modified_base (97)..(97): a, c, t, g, unknown or other
  misc_feature (97)..(97): n is a, c, g, or t
tcagtgtactactccacgaccggtgctcgatttagtagtgtagattcgcgggggtcggactcagtcaggacacagcatggacatggagggtccccgntcagctccgtgggggctcctgctgctctggctccaggtactacaatgtgacatccgagatcgacccagtcctccttccaccctgtctgctatcctggtcggaagccgagtacgccaccatcaccgttcggcccgggcagtcaggtacgtggtttacggtaccgttggttcggcgttagtacgtcgacgacgaaggtaaaaccgaaggggaaaacctccccgtaaaggtccctccgtacggtaacttaccgttaagtacggttacgtttaccgtacctaaccgtaagtttaacgggtaacgggtaaaacgggttccggggtaacccctaagggttaaccgttaacgggttccggaacgggtcggtacggtaacggggtttacggacggttacgggtaacggggaactaacggtttaaacgttcctaaaccttccgtaactaacccgtaacgtttacggaactaccgaaccgttaccctaacggaccggtaccgtagtacgttaggtttacgtttacggtactttaaccgtttagtttacgtaccggtaactaacggtaagttaagttaacgtttacgtttaacttaccgtaccggtttacccggaccgttaacgggtacctaagttcggtactaagtacgtaacgtaaaacggtcgtaggttcggactcgaaccgtcttactccttacttccgttccgtacc

SEQ ID NO: 167510 - DNA, 802 bp, Homo sapiens
  misc_feature: GYAE6OF01CMVTP.16.81.H04.1.454.CMB.1.raw
  modified_base (231)..(231): a, c, t, g, unknown or other
  misc_feature (231)..(231): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctcccttccaccctgtctgcatctgtacggagacagacgtcaccatcacttcggccgggccagtcagngttgtggtacctgatcggcctggtactcgagacaacgaaaccgagggaaacgaccctaagcctccgtagtacttctatgtatcgtactacctaagtagtaagggaacggtccggggtacccaagttaccgtaaggttccgaacgggaccggcgaacggttggtagttccggtaggggaactaggtaaacttccgtacttacccgacctaacccgtaataaccgaccggtaccaaccggtacccgtaacctaccggtaacccttagtaacgttaggttttaccggttttaaccggtaccggttaaactttttaatttaaacgttaccggtaaaccctaaaggttaactttaaagggttaaaacgtttaacgttttaaaccgttacccgtttaaaccgggtttccccgggtaaccccgtaacgggggttaaaccccttaaggttaccgggttaaacgggtaaacgttaaacccggttaaacggtaaaaccggttaaaccgggtttacgttacgggtaccgttaacccgtaacccgtaccccgttacggttttacccttaccgttttacccccg

SEQ ID NO: 167511 - DNA, 741 bp, Homo sapiens
  misc_feature: GYAE6OF01DKE3O.16.81.H04.1.454.CMB.1.raw
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (723)..(723): a, c, t, g, unknown or other
  misc_feature (723)..(723): n is a, c, g, or t
tcagtgtactactccacgaccggtgctcgatttagtagtgtagattcgcgggggtcagactcagtcaggacacagcatggacatgagggtccccgctcagctccgtggggcctcctgctgctctggctcccaggtatcaaatgtgacatccagatgaccctagtcctccttccaccctgtctagctatcgtggtcggacgacaggacgtccaccatccgtacttcggccggccagtcaggtagttgtcggtaccgttgggtcgtccgttggtatcaagtacgaaacgaaaccgacgggaaacncccctaagcctccgtagactcgtaagngtacttcgtacctactaagtagtacgggtaaacggtccgggtacccaagtacggtaacggtcgacggtacggcgtaaggtacggtacgtcgggtaacggggtaacaaacggttacttaccgtaaccgttacccgtacctaacctaccgtacgaacgcccgtaaccggtacccgtaaccacggtaccgtaaggttaacgttcgtttaacggttttccgaacgtttaaccgttttaagttaaccgttaccggaacctaaacgtaacgttaaacgtaagtttaacgtttactttacccggtaaccgtttccggacccgttacggacttaaacggttggtaaagtacgtaaactaacggaacgtacggttccggtacggtacaccgtccgtaaactnttaccgtcttcgtaaccc

SEQ ID NO: 167512 - DNA, 817 bp, Homo sapiens
  misc_feature: GYAE6OF01AID9R.16.81.H04.1.454.CMB.1.raw
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
  modified_base (474)..(474): a, c, t, g, unknown or other
  misc_feature (474)..(474): n is a, c, g, or t
tcagtgtactactccacgaccggtgctcgatttagtagtgtagattcgcgggggtcagactcagtcaggacacagcatggacatgagggtcccgctcagctccgtggggctcctgctgctcgtggctccaggtatacaagtgtgacactaccagatacgaccagttcctcccttcctaccctgtactgacctctcgtcggtacgaggacgagtacgtaccaccacttaccgtcggttacgggccgggacctacggtacgtacggtacggtcggtttcggtaccggttgggttacggcgttagcgtacagaaccgaacgaaaacgggacgtaacccgacctaacgtcctccgtacgtataccgtntacgttacnccgttactaatacgtaagggtacgggtaacggtcgtaacccgagaaccggtaggttcacggngaggtagcgttacggacgtaaggacgtaactcggttacncccttacgactaactacgtacgacgtaccaaccgtcgtaaccctacggtaccgtacgtacgtttacgtacgttttaccgtaacgtttactttaaccgtaaccgtttaccaaacggttaaacggttaattaaaccgttttaacggttaaccctttaaccggtttaccgggttaaacccggtttaccccggggaaagttacccggggttaacgttaacggggttagtaaacccggtttaaagtaaaacccggtttaacggaaaccggttacggttccggggacgttaccggtaccttaaacccgttacggtttacctacccgtttcggtttaccctttaacccgg

SEQ ID NO: 167513 - DNA, 922 bp, Homo sapiens
  misc_feature: GYAE6OF01BIQUY.16.81.H04.1.454.CMB.1.raw
tcagtgtactactccacgaccggtgctcgatttagtagtgtagattcgcgggggtcagactcagtcaggacacagcatggacatggacgggtccccgctcagcctccgtggggcctcctgctgctcgtggcctccgagtactacaaagtgtacacagtaccgagacgtcgaccctagttcccttcccgtaccctaccgttgtcctggacttgtaccggttggaccggaagaaccgtaggtaccgtaccaacccgttagtaccttaaccgggttccgggccccgggtaaccgtaacgggttaccgaagggtttacgggttttccgggtttacggggttaacccggtttggggttccggtaccgtttaggttaaccgtaccgaaccggtaaccgaaaaacgggaaaacccggtaaaccggggttaaacccgtacccccgttaacgtcccgttaccggtagtaacctttaggttaacgttcgttaacgttaccgtaccttaaacggtacgtaaagggttaaccgggttacggggtaccgttaaccgtaagttacgggtaacgtccggaaagggtcccggtaagtacggtacggaggtttacgggaaacggtaacgtactaaacgtttacccgtacctaccgtaacccaacgtccgtaaccgtaacgtacccgttaaccgtacccgtaacgttacggtaccttaaggttaagtttaaccggttacgtttttaccgaaccttttaacgttaagttaccttaaacggtaactaacggtttaataaacgtttaacgtttaacttaccggttaacgttacccgttacccgttacggtaacgtacgttaggttacgtaacgtaacgtacgaaaccgtatacgggtacgtacgtaaccgcgttaccaccgtagtttcttcccgttcctaccc

SEQ ID NO: 167514 - DNA, 752 bp, Homo sapiens
  misc_feature: GYAE6OF01BDM2L.16.81.H04.1.454.CMB.1.raw
  modified_base (197)..(197): a, c, t, g, unknown or other
  misc_feature (197)..(197): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtgacatccagatcgaccctagtcctcccttccaccctgtctgctatcgtggtcgganacaggacgtccaccatcgacgttcggcccggctagtcaggtagttggttacggtaccgtgggttacggcgttaggtactcgacgacgaaacggaaaccgaacgggtaacctaccccgtaagtcctaccgtagtacttacgtagtagtacgttcgtacctaccgtaagtaagtacgggtaacggttaccgggtacctaagtacgtaacggttacgacggcggtacgaggttacggacgtacggtaggtaacgtaacggtacttaccgtaaccttaccgtactacctacgtaccacggtactaaccgtacctaacgtacgtaccgttagtacttaggttacgtttacgacctttaatttacgttacctaacgtaaccgtaattaagttaacgtttaacgttacgtttaacttacccggttaaccggtttccggaaccgtacgggtaacctaggttacggtaacgttaaacctaaacgtaaaccgtaacggttaacgttgggtccgtaaccgtaccggtacctttaactacgttcgttaacccgttcttaacccccgg

SEQ ID NO: 167515 - DNA, 861 bp, Homo sapiens
  misc_feature: GYAE6OF01EMBLN.16.81.H04.1.454.CMB.1.raw
  modified_base (191)..(191): a, c, t, g, unknown or other
  misc_feature (191)..(191): n is a, c, g, or t
  modified_base (505)..(505): a, c, t, g, unknown or other
  misc_feature (505)..(505): n is a, c, g, or t
  modified_base (771)..(771): a, c, t, g, unknown or other
  misc_feature (771)..(771): n is a, c, g, or t
  modified_base (845)..(845): a, c, t, g, unknown or other
  misc_feature (845)..(845): n is a, c, g, or t
tcagtgtactactccacgaccggtgctcgatttagtagtgtagattcgcgggggtcagactcagtcaggacacagcatggacatggacgggtccccgctcagctccgtggggcctcctgctgctctggcctccaggtactacaatgtgacactccaagtatcgaccctagtccttcccttaccctaccgtntctagctacgttcgtcggtacggaacgtacaacggtaccacctaacctacttaccgtaccggttaccgggacccgggtacctaacggtacgtacggtaagggttttcgttacgggttaccgtttgggtacggtccgttagtacgtacggacggaaacgaaaccggtaaaaccggtaacgggaaacctccccgttaacgtcctacgtagtactttaccgtagttcggttactaccgttaccctaagtaaagttacgggttaacggggtaacgggttaccgttaccccgtaagtaccggtacggtagtaacccggngggttaacgtaacgggtgtaacgttacgggaagaaccgtaacgtttacaccgttcctaacgtaacctacggtacgtaacctacggtacccaaccgggttacctaccggtaccgttactcggttaaacgtttcgttttacgtacccgttaaagtttagttttaacctacggtaacccgttaaactaaccggttaagtaaccgttttaacggtaatttttaacccgttaccccgttaacgggttccccggaacgttaacgggttaacngggtttaaaccgattaaacgaacccgtttacggaaaccgtggtacggacctacggaacgtccttaacgttcgtntttacctccgttaccc

SEQ ID NO: 167516 - DNA, 664 bp, Homo sapiens
  misc_feature: GYAE6OF01CE15T.16.81.H04.1.454.CMB.1.raw
  modified_base (191)..(191): a, c, t, g, unknown or other
  misc_feature (191)..(191): n is a, c, g, or t
  modified_base (277)..(277): a, c, t, g, unknown or other
  misc_feature (277)..(277): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacaggactcacatcacgttgcccggccagtacagagttgttggtacctggttggcctggtatcagcaaagaaaccgaagggaaacncccgtaagcctcctagacttacctagtgtaacgttcgtacctacaaagtaacggtaggtaaaacgggtcgggtaccctaagtacgtaaagggttaccgaggcggactagggtagtaacgtcggtacgggaactaagaaacttcaacgtcctacgaacctctacacggactaacgtcctaacgacgtccgtaagtacttaggttaacgttttcgacgtttaactttaattagttaccgtaactaaacgtattaaacgtaaagttaagtttaaccttacgtaaccgttttccggaaccgttcgggaacttagtcgttagtaaacgtataaaccgtaaacgtagtacggttacacgttacgaccttaccgtattaccgtcgttcttaccg

SEQ ID NO: 167517 - DNA, 795 bp, Homo sapiens
  misc_feature: GYAE6OF01A03GP.16.81.H04.1.454.CMB.1.raw
tcagtgtactactccacgaccggtgctcgatttagtagtgtagattcgcgggggtcagactcagtcaggacacagcatggacatggacgggtccccgctcagcctccgtggggctcctgctgctctggcctacccaggtatacaaatgtcgacatccagactcgaccagttccttcccttaccacccttgtctcgctacgttcgtacggtacggaacacgaacgacgtaccaccgtaataccgtacggttccggaccggactacggtcgtaaggtggttcggttacggtcgttgggtccggtcgtaggtactacgacggtaacgaaacggaaacggaaccgggaaccaccgtaacgtcctaccgtagtacctacgtatacgacgtcttacaacgtaagtaggttaacgggaacgttccgggtaactacgtaacggtaacggtacggacggtaccggtaactggggtactaggtaccgtaaggtaacgtaacgttaacctctaacgtacccgtacaaccgtacacgaaccgtaccgaacgtaccgtaaccgtacgttaccgtacgttaagtttcgttaaccgttttagaaccgtttagtttaccgttaacgttaaccggacttaaaccgtaagttaaccgttaagttaaccgtttaacttacccggttaccggttacccgggttaacgtaacggtaacttacggtaagttaaccgtaattaaacggtaaaccgaacggttacgtacggtacggtaccgtacgtaaccctacgttacttacgtctttccgtaaaccc

SEQ ID NO: 167518 - DNA, 840 bp, Homo sapiens
  misc_feature: GYAE6OF01C5JX4.16.81.H04.1.454.CMB.1.raw
  modified_base (150)..(150): a, c, t, g, unknown or other
  misc_feature (150)..(150): n is a, c, g, or t
  modified_base (217)..(217): a, c, t, g, unknown or other
  misc_feature (217)..(217): n is a, c, g, or t
  modified_base (302)..(302): a, c, t, g, unknown or other
  misc_feature (302)..(302): n is a, c, g, or t
tcagtgtactactccacgaccggtgctcgatttagtagtgtagattcgcggggtcagactcagtcaggacacagcatggacatggacgggtccccgctcagcctccgtggggctccgtgctgctctggcctccgaggtatacaaatgtanacatccagtactcgaaccctgtccctacccttaccacccttgtctacgctacgttcgtgtacggaanaaccaggactaccaacctactaccgtactcggccggacctagacgagttaggttcggttacgtacgttgggtacgtcttggttanaccgaagtacaaacggaaacgacggaacctaccgtacgtctacgagtaactcttagtatactacgtactaacggttaaatcggtaacggtaaacgtccggtaaccagttaacggtaacgttcacgggtaccgtagtaagtcggtagtaaccggtagaacctaaggtaacttccccgaagtacctaccgtaaccgtaagccgtaacgacccgtaaccgtaaccgtaacgtaccgtacgttaacgtcttaaacggttgtttttaaccgaacgtttaactttaacgtttacgtaaacccgtaaacgttaaccgttaaaagtttaacgggttaaactttacggttttaaaacccgtttaccgttaaaccggttaccccggtaaccgttaaaccgggtaaccttaaagggttttaccgaaaagtttaaacccgtaaccggtaaaaacggttaaacccggttaacttcccggggttaaaactcgttaaacccccgggtactaaaccgttttaaccggtccggtaaacctttttaccccggtacc

SEQ ID NO: 167519 - DNA, 699 bp, Homo sapiens
  misc_feature: GYAE6OF01DEUC1.16.81.H04.1.454.CMB.1.raw
  modified_base (168)..(168): a, c, t, g, unknown or other
  misc_feature (168)..(168): n is a, c, g, or t
  modified_base (313)..(313): a, c, t, g, unknown or other
  misc_feature (313)..(313): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
  modified_base (655)..(655): a, c, t, g, unknown or other
  misc_feature (655)..(655): n is a, c, g, or t
tcagtgtactactccacgaccggtgctcgatttagtagtgtagattcgcgggggtcagactcagtcaggacacagcatggacatgacgggtccccgctcagctccgtggggctcctgctgctcgtcggctcccaggtactacaaagtgtgacatccagactcgacccncgttcctcctcccacccttgtctgactgttcgtcggtacggaagacgaggactaccaccctataccgtccgttccgggaccggaccgtagtacgtaggtacggtttcggttcgggttaccgttggggttccgtaccgtggttacncggaacgtaacaacggtaaaccggacggaaccgtaccgtacgcctgtactactactagtactcgtacttccaacgtaagtggtaacgggtacggcggtacctagtacgtagtccggagtggacgtgccgtagaccggangtaacgtntacgctcgaacaccgtcgtaacgnaccgactccgaacgcccttagtgtaacgttgtacgttacgtctttaacttagttacgactacgtaaacgttaagtacgttaaacgtgtttaaccctttaacggtcccggtttaacccgtaggtacgttacgtacgttacgtaggtaaaccgttaagtaacctagaccggtnttacgacccctcgtacctaccgttattccgtcgtttccctaccg

SEQ ID NO: 167520 - DNA, 807 bp, Homo sapiens
  misc_feature: GYAE6OF01C6EHL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttcccaccctgtctgcatctggtcggagacagacgtcaccatccgacgttcggcccgggtaccagtaccagtaggttgttacggtaccgttgggttcgtccgttggtactcgagaccgaagaaaccgagggaaaccgcccctaagtccctccgtagattctagtaggtacttcgtacctaaccgtaagtaggtaacgggtaacgggttccgggtaccctaaggtaccgtacggtacacgggccggtacgtaggttggaacgttcggtaagggtaactaagtaccttaccgtacctccgtaacccacctacgtacctacgacccgtaaccgacccgtaacgtaccgtccgtaagttacgtttagtttaaccgttttcggtaaccttttaaccgtttaagttttaaccgtaccgtaacccgtaaacgttaaggttaaacgtttaaggtttaacccgtttttaacgtttaaccccggtttaacccggttttccccggggaacccggttacgggtaaacccttagggtttaaccggttacgggttaacctttaaacggtaaacccggtaaacgttccggttggtaacccgttacgtaacccggtcctaaccggttacgtttcccgttacgttcccgtttacccc

SEQ ID NO: 167521 - DNA, 760 bp, Homo sapiens
  misc_feature: GYAE6OF01EKQ8M.16.81.H04.1.454.CMB.1.raw
  modified_base (150)..(150): a, c, t, g, unknown or other
  misc_feature (150)..(150): n is a, c, g, or t
tcagtgtactactccacgaccggtgctcgatttagtagtgtagattcgcgggggcaggagtcagactcagtcaggacacagcatggacatgagggtccccgctcagctcctggggcctcctgctgctctggctcccaggtatcaaatgtnacatccagatgacccagtcctcccttccacctgtctgcattcctgtcggagacagacgtcaaccatctaccgtcggccccggaccagtcaggtagttcggttggtaccgttgggttcggtccgttggtactccgtagaccgaaacggaaaccgaacgggaaaccgtacccccgtacgtccgtaccgtcgtacttacgtagtagtacgtcgtacctacgtaagttaagtagggtaaacggtcggtacctagtacgtaacggtcgacggccggagtaggtacggtagtcgtagggtaactaacgtacttactacctcctaaccgtaccctactacgacgtacctacgaccgtaacgacctacgtacgtagttagtttacgttttcgtaaccgtttacttttaactttacgttacctaaaccgtaacgttaaacgttaaagttaacgtttaaacggtttttaacctttaaccggtttaacccggttcccggtacccggttaacgggtaaaccttaacggtttaggttaaccggttaaataaccgttaaaccggtaaaaccgttacggtacgggttacgtacccgtaccggtaccttaccgttacggtttcccg

SEQ ID NO: 167522 - DNA, 854 bp, Homo sapiens
  misc_feature: GYAE6OF01APDAH.16.81.H04.1.454.CMB.1.raw
  modified_base (192)..(192): a, c, t, g, unknown or other
  misc_feature (192)..(192): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaatgtgacatccagatcaccagtcctccttccaccctgtctgcatctgtcgganacagtacgtccacatccacgttcggccggcagtcagtagtgttcggtaccgtggtgccgtggtatcagtcaacgtaaaccgaaggggaacctccccgtaagcctcctagtactactatgtactgttacctacctaagttaggtaacgggtaaaacgggttccggggtaccctaacgtacgggtaaacggtttacggacgggtacccgggtacgtaacgggttacggtaacggttaccggtaggggtaaacccttaacgttaaactttccgtaacccgttaccgtacctaaacccgttataacccgacggtaacccgtaaccgttacccgtaaacccggtacggtacccgttacggtaacctttagggtttaaccgttttacgggtaacctttaacggttttaaccgttacggtttaaccgggaaacccttaaacgggttaaacgtttaaaggttaaaccggttttaacccgttttaaccggtttaaacccgtttaaccccggggttttacccggaaccccggtttaacgggtaaaccccgtttaaggttaccggttaaaccggtagtttaaacccgtaacggtaaaacccggttacgttaccgggtaacggtacccttacgggtaccccttaaccgttacctttcgggttccgttaaacccg

SEQ ID NO: 167523 - DNA, 713 bp, Homo sapiens
  misc_feature: GYAE6OF01B0UWA.16.81.H04.1.454.CMB.1.raw
  modified_base (488)..(488): a, c, t, g, unknown or other
  misc_feature (488)..(488): n is a, c, g, or t
  modified_base (638)..(638): a, c, t, g, unknown or other
  misc_feature (638)..(638): n is a, c, g, or t
tcagtgtactactccacgaccggtgctcgatttagtagtgtagattcgcgggggtcagactcagtcaggacacagcatggacatgacgggtccccgctcagctcctggggctcctgctgctctggctcccaggtatacaaatgtgacatccagatcgacccagtcctcctccacctgtctgcatcgtcgtacggagacgagacgtaccacactcgtacgttccggcccgggaccaacggtaccgaggtagttcggttacgggttaccgttgggttcggtccgttaggtaatcgaacggacgaaacggtaaaaacccgggaaccgggtaaaccgaccccgtaagtcccgtaccgtgtaacttcgtaattcgaagttccgtactaaccgaaattaacggtaggggtaacggtccgggtacctagtaacgtaacggtcgaggcggtcgaggtgagttcggaggtacgaatacttaccacgtctaccgacanccgacgaccgacgtacccagcgtactgtacttgttactttacggactttaagttgttaaccttagaccctaaataacggttaattaaacgttactttaacgtttaacgtacccggtttaccggtccgtacgtaacgttagtacggttaanaccggttaataacccgaaggtttcgacgggttcaaccgtcgtaaaccgttcgtacgtcgttcttccgtttaaccg

SEQ ID NO: 167524 - DNA, 860 bp, Homo sapiens
  misc_feature: GYAE6OF01AOM7C.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccaccctgtcctgctatcgtggtcggagacgagtacgtcaccatcacgtcggccggcagtcagtagttggttcggtaccgttggtcgtccgttaggtactcgtacggacgaacggaaaccggaacgggaaaccgtacccccgtaagtccgttacctacgtaacttcgtaacgtgtaacttcgtacctaccgaagttacggtagggtaacggtccgggtacctacgttacggtaacggttccgacggtccgtaggtacggtaggtaacgtcgggtacgggaagtacgttaaaccgttcctaccttaccgtaccaccgtactccggaacgtccgtaaccgtaccctacggccgtaccgttagtactttacggtttaccgtttacggactttaaaccgttttgttaaccgttacggaaaccgttaaccgttaaaggttaacccgtttaaacggttaccgtttttaacccgtttaaccggtttaaccccggtttcccgggtaaaccgggtttaccgggtaaaaccgttacgggtttaacgggttaccgttaaaaccggtaaccgtttaaaacccgggttaaaacccggttacggttttccggggttaacccgggttaaccgtttaaccccgaacccccgggtttaacccgtttaacccgtttcccgtttaacccgttttaccccggtttaccccg

SEQ ID NO: 167525 - DNA, 574 bp, Homo sapiens
  misc_feature: GYAE6OF01E18QS.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagacgtcaccatcacttggccggccagtcagagtgttggtacctggttggcctggtatcagcagaaccagggaacgcccctaagctcctgatctatgatgtactaccaatagtaggaagtcgggtccagtcaaggtcagcggacaggtggatcgtggacagtactcactctcaccatcacgacacgacctacgacgtcctagtattgtatttgactactttattacttacgaccaacgtagttaacgtaagtacgtttattacccgttaaccgtttccgggacccgttagggtaacctaaggttcgttaggtaacttaacgtaccgtaaacgtaacgtggttacggtactacgacctacctacttccgtcgttccttaccg

SEQ ID NO: 167526 - DNA, 641 bp, Homo sapiens
  misc_feature: GYAE6OF01AY0AE.16.81.H04.1.454.CMB.1.raw
  modified_base (193)..(193): a, c, t, g, unknown or other
  misc_feature (193)..(193): n is a, c, g, or t
  modified_base (268)..(268): a, c, t, g, unknown or other
  misc_feature (268)..(268): n is a, c, g, or t
  modified_base (421)..(421): a, c, t, g, unknown or other
  misc_feature (421)..(421): n is a, c, g, or t
  modified_base (467)..(467): a, c, t, g, unknown or other
  misc_feature (467)..(467): n is a, c, g, or t
  modified_base (602)..(602): a, c, t, g, unknown or other
  misc_feature (602)..(602): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcgagacngagtcaccatcacttgccgggccagtcagagtgttggacctggttgcctggtatcagcagaaaccgagggaaacncccctaaggcctaccgatctacgtatactagttccgtacctaactaagtaggtaaggtaacgggtccgggtacctagaacgtacgtacgcggtacgacgtaggtacgtctaggggtacgaacgtaagtacttaccacttaccgaaccacgtanacgcgaacacccgtctaacgacgtcgtaagtacgttaattgtttanaccgtttaattactttacgtaccgaactaagttacgttaagtaaagttacgttaaccgttaccgtttaccggttccgtaccggttaacgaacttgtagacgtaactactaaaccgtaacgtacggtagccgttancgttaacccattacccggttatcgttacctcgttacccg

SEQ ID NO: 167527 - DNA, 895 bp, Homo sapiens
  misc_feature: GYAE6OF01ALH4W.16.81.H04.1.454.CMB.1.raw
  modified_base (307)..(307): a, c, t, g, unknown or other
  misc_feature (307)..(307): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtactacaaatgtgacactccagatcgacccagttcctacccttcccgaccctgtctgctatctgtcggagacagacgtcacctatctacgttggcccgggcagtacaggtagttcggttacggtaccgttgggttcggccttggtactcgagacaacggaaaccgagggaaaccnccccgtaagcctacctagtacttacgtatagtacttcgtacctaccgtaaataggtaacgggtaacggtcgggtaccctaaggtacgttaaacgggttccaacggtcggtaaccgagggttacggtacgttacgggtaagggtaactaacggttaaccttaccgtaccttaccgtaacccgtaactacgtaccgacggtaccctaacccgttaccgtaaccgtaccggtaccgttaagggttaactttacgggtttaacgtttaccgttacccgtttaaacgtttaacgttttacgtaacccggtaaccttaaacgttaacggttaaagttaaacggtttaacgttttaaaccggttttaaccccggtttaaccccgggttaaccggggttaccccccggttaaacgggttaaacccgttaaggtttaacgggtttaaaccggtaaaaccgttaaaccggttaaacccgtaaaagggtttaacccgggttcggttaaccccggggtaccttaaaccccggggtttaacccctaacccttttaaagggtttccccttttaaaccgtttaccccgggttttaaacccccc

SEQ ID NO: 167528 - DNA, 722 bp, Homo sapiens
  misc_feature: GYAE6OF01E3DCQ.16.81.H04.1.454.CMB.1.raw
  modified_base (399)..(399): a, c, t, g, unknown or other
  misc_feature (399)..(399): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctcccttccaccctgtctgcatctggtcggagacgagacgtaccaccgtatccaccgttcggcccgggaccagtccagtaggttggttcgtaccgttggttcggccgtggtactcgacgtcgaacgtaaaccgacggggaaactccccgaaggccttaccgtgacttcgtataggtacttgtacctaccaagtagtacgggtaaacgtcgggtacctagtacgagttcgagcgtanaggtcgtagtcgtaggaacagtactctactctaccactactacgacgacgtacacctcgtacgtaccgtatgttaagttacgtttacggtaccgtttaactttagttacgtaccgtaccgtaaacgttaacggttaacttaaacgggttacctttaacggtttaccgttaacccgggttttcccggaaccggtagggttaaccctagggttcggttaaacggtaccttaacggtaaaccgttaaaaccgggtacggttacgggtccggtaaccgtacccggtaaccctagtaaccgttttccgtttccgttccgtttaacccg

SEQ ID NO: 167529 - DNA, 654 bp, Homo sapiens
  misc_feature: GYAE6OF01CXZSP.16.81.H04.1.454.CMB.1.raw
  modified_base (142)..(142): a, c, t, g, unknown or other
  misc_feature (142)..(142): n is a, c, g, or t
  modified_base (191)..(191): a, c, t, g, unknown or other
  misc_feature (191)..(191): n is a, c, g, or t
  modified_base (273)..(273): a, c, t, g, unknown or other
  misc_feature (273)..(273): n is a, c, g, or t
  modified_base (428)..(428): a, c, t, g, unknown or other
  misc_feature (428)..(428): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgngacatccagatcgaccagttctcctccacctgtctgctatttcgcgganacgtagagtccacatcgaccttggcccggtaccagtcgacgtagttcggttcggtaccgtggttcggcttggtatcgacganaaaccggaaacgaacgggaaccgaccctaggcctacaggtactcgtaatcgtagttctacctacgtaagtacgtaggtaaacgggttcggaaccctagtaccgaggttacgaggaccggtgaacggtggaattcggaggaactagaattccactntaaccgacttaacgaccagtacactaccacgacgtctagtactagtaacttgtaccttattagttactacgtacaacgtataagttaacgaagtttacgtttaaactaccggtttaccgaccggttacgtacgtaagtaccggttagacgtttaacaaccgttaaacgtagttaacggttcggaacttaccggaccttacacgtttacacgtttcacggttacccc

SEQ ID NO: 167530 - DNA, 719 bp, Homo sapiens
  misc_feature: GYAE6OF01A4GY9.16.81.H04.1.454.CMB.1.raw
  modified_base (690)..(690): a, c, t, g, unknown or other
  misc_feature (690)..(690): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatacaaatgtgacatccagatcgacccagtcctcccttccaccctgtctgcattcgtgtacggagacagacgtaccaccatcacgttcggcccgggcagtcgagtagttggttcgggtaccgtgggttcggccgttggtactagacgaccgaacggaaaaccgaacgggaaaccgaccccgtaaggccttcctaggtactctagtgtactcgtacctaccgtaagttaaggtagggtaacggtcgggtaccctagtacgtaacggtcgaacggtccggacgtaggtacgtacgtacgggtacggaacttaacggtaacttcccgtacgttacccgtacccaaccgttaaccgtctaaccggcctaaaccgtccccgttaacgaccggtaccgttaagtagttttacgttagttttaccggtaactttaaccgttttagttacgtaaccgaacgtaacgttaacgttaagttaacgttacgtttacttaccgttaccgttacccggtacgtacggtaccttagcgtacgtactaacgtaacgactaggtcggacgtntacgtctactagttcctgttaccttcccg

SEQ ID NO: 167531 - DNA, 707 bp, Homo sapiens
  misc_feature: GYAE6OF01EZVT4.16.81.H04.1.454.CMB.1.raw
  modified_base (98)..(98): a, c, t, g, unknown or other
  misc_feature (98)..(98): n is a, c, g, or t
  modified_base (265)..(265): a, c, t, g, unknown or other
  misc_feature (265)..(265): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
tcagtgtactactccacgaccggtgctcgatttagtagtgtagattcgcgggggtcagactcagtcaggacacagcatggacatgagggtccccgctnagctcctggggctcctgctgctctgctcccaggtatcgaaatgtgacataccgagatcgaccagtcctcctccaacctgtcctgcatctgacggagacagagtccaccagtcactcggccggcaagtcaagtcgtagtttcggtacctgggttacgtccgtggtacncgtacgtacacgaaacgacggaaagacccctaagctacactncgtatacgatgtactccaagtactaggaaggttcggaccagtacaggttaccagtccngacgtggactggtcggtaacaagtactacgtacgtactcaaccgaacgttcacgacgaaccgtaccgtaaccgtaggaacccgtagtaacttacggtacttttacgggtaaccttaaccgtttacgttttaaaccttacggtaacccgtaaaccgtaagtaaccggttaaaaggtttacgtaaacgtttaccgtttaaacggtttaaccccggtcccgttaaaccgggaccgtttaaacgtcggttaacgtaaaccggttagttaaccgaaaacccgttaacgtacggttaacggaccctacgggtaactaccgtaaaccttcgtaacgttcggtttaaccc

SEQ ID NO: 167532 - DNA, 800 bp, Homo sapiens
  misc_feature: GYAE6OF01EDSY5.16.81.H04.1.454.CMB.1.raw
  modified_base (96)..(96): a, c, t, g, unknown or other
  misc_feature (96)..(96): n is a, c, g, or t
tcagtgtactactccacgaccggtgctcgatttagtagtgtagattcgcgggggtcagactcagtcaggacacagcatggacatgacggtccccgntcagctccgtgggctcctgctgctgtcggcctccgaggtatacaaatgtacgactacgtccgaagactccggaccctagttcccttaccctttacccgaccctttggtactcgtcctacgttcgtacggtaccggagaccgacgtaccgtaccacctaacgttccgtaccggttcgggcccggaactacggacgtagggttacgggttcggtttacggttaccggtttgggttccggccgtttaaggaaccgttccgaacgaccggtaaaacggaaacccgggtaaggtaaaccccgtaccgttaacgccgtttaacgtagttaacgtaccgttagttacgactttccggtaacctacgttaaggtacggttaaacggacggttccgacctaggtaccggttacgtcggaggcgttgagttcgacgttgacggtaatagtaaaccgttccctaattcccgaacacgttacaccgtagaccctaaggaccaaggtaccttcgactttagttacgtttagtttactccgtttacttacgttactacgaactaattaagtaactaggtttactacggttacccgttacgtccggttaaccgacgttacgtcgttacggttaacgaacctttaacggaacgttaacggttcttaccgggcgttaaaccgcggtacccttaagttcccgttcgtttaacctcttacccg

SEQ ID NO: 167533 - DNA, 702 bp, Homo sapiens
  misc_feature: GYAE6OF01BH5B6.16.81.H04.1.454.CMB.1.raw
  modified_base (353)..(353): a, c, t, g, unknown or other
  misc_feature (353)..(353): n is a, c, g, or t
  modified_base (444)..(444): a, c, t, g, unknown or other
  misc_feature (444)..(444): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatacaaatgtcgacactccagatcgaccctagtcctccttccctaccctggtctcgactgtcgtacggtcggagaacgagacgtccaccacgtccgtacgttcggccgggcacgtcgagtgttggttcggtaccgttgggtcggtccgttggtactcgagacgtaaacggaaaccggtaacggaaccgtaccccgtaagcctactgacttactgtacgnttcggtaccacgtaagtacggtagggtaacggttccgggtacctacgtacgtacggtcgacggcgtacggtaggtcgaggtcgacggtaanacggttactccctctacccgactaactcacgacgcaccgcctacgaccgtcgtagtacgttagttcgtttacgtacgttaacgtttgttacgtacctaacgtaaacgtaaggttaagtaacgtttaactttaacgttaccttaaccggttacccggtacggtaccggtaaccgtaggtaccgtagttaaccgaacgttaacgtaaacgttcgtcggtacgtacgacgtaccctaggttaacctcgtttcgtccttacg

SEQ ID NO: 167534 - DNA, 915 bp, Homo sapiens
  misc_feature: GYAE6OF01BE8R3.16.81.H04.1.454.CMB.1.raw
  modified_base (595)..(595): a, c, t, g, unknown or other
  misc_feature (595)..(595): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccagtatcaaatgtgacatccgagactcgaccctacgttccttcccttcccacccttgtcctgctactcgtcgtcggacgaccgagacgtaccaaccatcctacgttcggcccgggtaccagtccgtaaggtaggtttcggtttacgggtacccggttgggtttcggccgtttagggttactacgaagtaccgaaaccggtaaaaccggaagggaaaacccgtaccccttaacggccgttacccgtagtaccttacgtacgtacgtacttacgtaccgttaaacgtaagtaacggttaacgggtaaaccggttccggggtaccctaaagttaccggtaacggttccgaacgggtcggtacgtacggggtacggtacgtcggtaaccgggaactaacggttaacttacctaccgtactactacccgtacgtaccaacgtcctaccgtaccccgtaagttaacccccggngttacgtaacgtttcgttttaagtttaccccgttaacgttaacctttttacgtttaccgttaaccgttaaacccgttaaccgtttaaggttaaccgtttaaggtttaacccggtttttaactttaaaccccgggtttaacccggttttaccccgggaaacccgtttacgggttaaaccggaacgtttaagggtttaacccgaaacgttttaaccgtaaaacccggtaaacccgggtttaaggtttccgggaacgttaaccccgtcggtaaacccttacccggttacggtttacccctttcccgggttaccttttacccgg

SEQ ID NO: 167535 - DNA, 729 bp, Homo sapiens
  misc_feature: GYAE6OF01DVJG0.16.81.H04.1.454.CMB.1.raw
tcagtgtactactccacgaccggtgctcgatttagtagtgtagattcgcgggggtcagactcagtcaggacacagcatggacatgagggtcccgctcagctcctggggctcctgctgctctggctccgaggtatacaaatgtgacatccgagactcgaccctagtcctccttaccaccgtgtctgctattccgtggtacggacgaacgtacggacgttaaccacctagtccgtacgtacgggtccggctaaggtcgagtacgttcggtcggtacggttcggtggtcgtagtactacagacgaacgttttaaccggaacggtaaaccgtaccgtacgtaccgtacgtactactactagtagtacgtacgtacctacgtaacgtaggtacggtaacggtacggtacgtacgtacgtacggtacgacgtcggacgtacgtagtacgtacgacggtacgtaacgtacgtactacgtctaccgactacgtacgacgacgacgtacgtacgacgtacgtacgtacgttagttacgttacgtacgtttaactttacgttacgttaacgtaaccgtaagtaacggttaaacgtaacgttaacgttaaccgttaaccgttaccgttacggtaccgttaacggtacgttacgttacgtaacgtaacgttaccgtaaacggtaaccgtacggttcgtacgtacgttactaccgtaacgttacgttactcgttcgttaccg

SEQ ID NO: 167536 - DNA, 715 bp, Homo sapiens
  misc_feature: GYAE6OF01DESJS.16.81.H04.1.454.CMB.1.raw
  modified_base (181)..(181): a, c, t, g, unknown or other
  misc_feature (181)..(181): n is a, c, g, or t
  modified_base (288)..(288): a, c, t, g, unknown or other
  misc_feature (288)..(288): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (631)..(631): a, c, t, g, unknown or other
  misc_feature (631)..(631): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatgacccagtcctccttcccaccctgtcngcatctgtcggagacagacgtcaaccatcacgttcgccggccagtcagtagtgttcggtactgggtcgctggtatcagacaagaaacgacgggaacaccagctcgtnagtctagtgtgtactcactaatagtagtaacggtgggtacccagtacgtaagtcggcggngcgtagngtagtcggtaggacactagttaccacgtcctacaactacgacgtaacgtacgaacccgtaactaacccgtcgtaaccgttaggtaacgtttactttacgggttttacgttacccggttttaacttttaacgttttaaccgtaaacgtttacccaaaaggttaaccgttttaaaggtaaaacgtttacccgtttaaaccgtttaaccggttttaacccgttaacccgggtttcccggggaaagttacccggtaaactttacgggtccgggtttaaanaaccgggtttaaaccaaagggtacgttaaccggggttcgtaaccgtcggtacctacttccgttcttaaccgttcttaaaccccg

SEQ ID NO: 167537 - DNA, 699 bp, Homo sapiens
  misc_feature: GYAE6OF01A9AB0.16.81.H04.1.454.CMB.1.raw
  modified_base (337)..(337): a, c, t, g, unknown or other
  misc_feature (337)..(337): n is a, c, g, or t
  modified_base (638)..(638): a, c, t, g, unknown or other
  misc_feature (638)..(638): n is a, c, g, or t
  modified_base (664)..(664): a, c, t, g, unknown or other
  misc_feature (664)..(664): n is a, c, g, or t
tcagtgtactactccacgaccggtgctcgatttagtagtgtagattcgcgggggtcggactcagtcaggacacagcatggacatgacgggtccccgctcagctccgtggggctcctgctgctctggcctccaggtactcaatgtgacatccagactcgacccagtctccttccacctgtctgctatcgtgtcggacacgagactccaccgactctaaccgttcggacccgggtacctagtccgtaggtacggttcggtttacgggtccgttaggggttcggccgttacggttacttccggaaggtaccaacgggaaaaacccgtaagggggaaaccnccccgtaaaggtccccttacgtagtaccgtccttagtcggtaactcgtacctaccgtaagtttagacgggtaacgggtccgggtaccctagtaaccgtaacggttcgacggacgtccgtagcgtactacgggtacgaacgtaagtactttacacgtttccacacctgtcgacgtcaccgtcaccggctactcggtatacgttatttccggtaatactttgtaacgtcgtaactaacgtaagttaacagtttacttacgttacgtaccggttaccgcgttaggaccttaagcgttaacgtanaaccgttagaaacgtcgtggtaccgngtaccactactagtttacgctttacgccttaccgg

SEQ ID NO: 167538 - DNA, 709 bp, Homo sapiens
  misc_feature: GYAE6OF01AN4RC.16.81.H04.1.454.CMB.1.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (323)..(323): a, c, t, g, unknown or other
  misc_feature (323)..(323): n is a, c, g, or t
tcagtgtactactccacgaccggtgctcgatttagtagtgtagattcgcgggggtcagactcagtcaggacacagcatggacatgagggtccccgctcagctcctggggctcctgctgctcgtggctcccaggtatcaaatgtgaccatccagatcgacccagtctaccttccaccctgtctgctatctggtcggagacagacgtcacatcacgtgccggcagtcagtagtgtcggtactggtgctggatcagcagaacgaggaacnccanctcnatnatgctgctacatataggacgtcgggccatacgagttcgagcgacnggtagtactggaggacaagtactacgactcctacctacgaacttaccaagtaccgacgtaccgtaaacgaccgttaccgtaagtacgtttaaccggttagttttacggtaacccgttaaactttacggtttaaccgtaacggtaaccgtaaagtaaacgttttaaacgtaaacggtttaaacgttttaccttaaaccggtttaaaccctttcccgggttaaccccgttacgggggaaaccttaaccggttaacgggtttaaacggtaaccgtaaaccgttaaaccggttaaaaaccggttacggttaacgggttcccgtaacccggttaacgtaccgggaaccctttaaccgttacggtttacccgttccccgttttaaacccggg

SEQ ID NO: 167539 - DNA, 858 bp, Homo sapiens
  misc_feature: GYAE6OF01B1DQH.16.81.H04.1.454.CMB.1.raw
  modified_base (225)..(225): a, c, t, g, unknown or other
  misc_feature (225)..(225): n is a, c, g, or t
tcagtgtactactccacgaccggtgctcgatttagtagtgtagattcgcgggggcaggagtcagactcagtcaggacacagcatggacatggacgggtccccgctcagcctccgtggggcctcctgctgctcgtggcctcccgaggtatacaaatgtcgactactccagtactccgaccctagttccttcccttcccacctgtcctgcctagtccgtgtcggaanacgagacgtccacctatcgtaccgtcggcccggtactagtacgtagtacggttggttcggtaccgttggtcggtccgttaggtataccgaacgtaccgaaacggaaaaccggacggtaaacccctccccgttaacgtccgtacgtagtacttaccgttagtgtaacgttccgtacctaacgtaagttacggtagggtaaccggttcggaccaagttacggtaaggtcgacgggtcgtacgtggtaggtacgtaacggtacggaaatacgttaaccgttaccctaccgttaccgtaacccaccgttaacgaccggaccgtaaccgtaccgttaacccgtaaccgtacggttaccttacggttacggtttaagtttaccggtttcctaacgttttaaacttttaggttaaccctaacggtaacccgtttaaaacggtaaggttttaaacttagtttaacccgtttaaccgtttacccgggtaccccgttttacggtaaaccccggttaagaaacccgggtttaagtcccggttaaacgttaaccgtttaaaacccgggacccgtttaaaacggttaccggttaacggtacccggagtaaacccccctttaacttcccggtttactttaacccggg

SEQ ID NO: 167540 - DNA, 488 bp, Homo sapiens
  misc_feature: GYAE6OF02H892E.16.81.H04.1.454.CMB.1.raw
  modified_base (407)..(407): a, c, t, g, unknown or other
  misc_feature (407)..(407): n is a, c, g, or t
tcagtgtactactccacgaccggtgctcgatttagtagtgtagattcgcggggtcgagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtccatcaaggttcagcggcagtggatcgtgggacagaattcactctcaccatcagcagcctacagcctgatgatttgcgtacttattatgcaanagtataagagttattcaactttcgcccttaggaccaatgtaggatagtcaaacgactgtaggctgacaccatctgtcttac

SEQ ID NO: 167541 - DNA, 479 bp, Homo sapiens
  misc_feature: GYAE6OF02IO60M.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcggcagtggatctgggacagaattcactctcaccatcagcagcctacagcctgatgattttgcgtacttattattgccaatatataagtagttattctaactttcgcctggaccatgtgatatcaacgatgtagctgcaccatctgtctc

SEQ ID NO: 167542 - DNA, 485 bp, Homo sapiens
  misc_feature: GYAE6OF02IJ2TF.16.81.H04.1.454.CMB.1.raw
  modified_base (330)..(330): a, c, t, g, unknown or other
  misc_feature (330)..(330): n is a, c, g, or t
tcagtgtactactccacgaccggtgctcgatttagtagtgtagattcgcggggagtcagactcagtcaggacacagcatggacatgagggtcccgctcagctcctgggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtccatcaaggtcagcggnagtggatctgggacagaattcatctcacatcagcagcctacagctgatgattttgcgtacttattacttgccaaacagtaataagtagttaattcaaacttttcggcctgggaaccatgtggataatcaaacgtaactgtgctgcaccatctgtc

SEQ ID NO: 167543 - DNA, 836 bp, Homo sapiens
  misc_feature: GYAE6OF02HC581.16.81.H04.1.454.CMB.1.raw
tcagtgtactactccacgaccggtgctcgatttagtagtgtagattcgcgggggtcagactcagtacaggacacagcatggacatgagggtcccgctcagctcctggggctcctgctgctctggctcccaggtatcaaatgtgacatccagatgacccagtctccttccaccctgtctgcagtctgtcggagacagagtcaccatcacgttgcccgggccagtcgagtagttggttacggtacctgggttcgccgttggtactcgagtacaaacgtaaaccggaagggaaaccgaccccgtaagcctaccgtagacttcttagtgtagtcgttcctaccgaattagtacgggaaaggttccggggtacccagtaccgtaacgggttacaacggtcggacgtagggtacggtaacttcgggtaggggaactaaggttaaacttaccgtaacttaccgtacccaacctaacgttaccgaacggtacaacggttaccctaacgacggtaccgttagaacgttacggtttaacgtttttcggaaccggtttaacttttaacgttttaacgtttacccgggaaaccctaaaacggttaacggttaaacgtttaaaacgggtttacgtttttaaaccttttaaccggtttaaacccgggtttttcccgggtaaccccgggtttaacggggtaaaacccttaaaggttttcggggttaacggttaaacgtttaaccgttaaaccggtaaaaacccggtttaacggttccgggttaccggttaccgttacggtaaccccgtaaccggttacttttaccggttaccggtttaccctttaaccccg

SEQ ID NO: 167544 - DNA, 484 bp, Homo sapiens
  misc_feature: GYAE6OF02FW1N7.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagtagttattcaactttcgcctgggaccaatgtgatatcaaacgactgtgctgcaccatctgtcttc

SEQ ID NO: 167545 - DNA, 487 bp, Homo sapiens
  misc_feature: GYAE6OF02HBFC1.16.81.H04.1.454.CMB.1.raw
  modified_base (411)..(411): a, c, t, g, unknown or other
  misc_feature (411)..(411): n is a, c, g, or t
tcagtgtactactccacgaccggtgctcgatttagtagtgtagattcgcggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgcctaanagtataagagttattcaactttcggccctgggacctaatgtgatagtcaaacgactgtggctgcaccatctgtctc

SEQ ID NO: 167546 - DNA, 492 bp, Homo sapiens
  misc_feature: GYAE6OF02HKZ8X.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagagtttattctaactttcggcctagggacctaagtgtagatatacaaacgtactgtgctgcaccatctgtcttc

SEQ ID NO: 167547 - DNA, 485 bp, Homo sapiens
  misc_feature: GYAE6OF02IH915.16.81.H04.1.454.CMB.1.raw
  modified_base (374)..(374): a, c, t, g, unknown or other
  misc_feature (374)..(374): n is a, c, g, or t
tcagtgtactactccacgaccggtgctcgatttagtagtgtagattcgcggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggtcagcgcagtggatctgggacagaattcactctcaccatcagcagcctacngcctgatgattttgcgtacttattattgccaaacagtaataagagttattcaaactttcgccctgggaccaatgtggatatcaaacgaactgtgctgcaccatctgtcttc

SEQ ID NO: 167548 - DNA, 489 bp, Homo sapiens
  misc_feature: GYAE6OF02HR4H5.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgactttattattgccaacagtataagagttattcaaacttttcggccctagggaccaagtgtggatatcaaacgaactgtgctgcacatctgtc

SEQ ID NO: 167549 - DNA, 489 bp, Homo sapiens
  misc_feature: GYAE6OF02JC36Z.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtactttattattgccaacagtataagtagtttattctaactttcggccctggaccaagtgtgatagtcaaacgactgtgctgcaccatctgtctc

SEQ ID NO: 167550 - DNA, 485 bp, Homo sapiens
  misc_feature: GYAE6OF02HPB19.16.81.H04.1.454.CMB.1.raw
  modified_base (482)..(482): a, c, t, g, unknown or other
  misc_feature (482)..(482): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcggcagtggatctgggacagaattcactctcacatcagcagcctacagcctgatgattttgcgtactttattattgcaacagtataagtagttatcaactttcggccctggaccaatgtgatatacaaacgactgtgctgcaccatctgtctntac

SEQ ID NO: 167551 - DNA, 486 bp, Homo sapiens
  misc_feature: GYAE6OF02GNEYQ.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagagttattcaactttcggcctagggaccaatgtggatatacaaacgaactgtgctgcacatctgtc

SEQ ID NO: 167552 - DNA, 494 bp, Homo sapiens
  misc_feature: GYAE6OF02JSK6I.16.81.H04.1.454.CMB.1.raw
  modified_base (411)..(411): a, c, t, g, unknown or other
  misc_feature (411)..(411): n is a, c, g, or t
  modified_base (491)..(491): a, c, t, g, unknown or other
  misc_feature (491)..(491): n is a, c, g, or t
tcagtgtactactccacgaccggtgctcgatttagtagtgtagattcgcggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacaggaattcactctcaccatcagcagcctacagcctgatgatttgcgtacttattattgcctaanacgtataagagttatctaactttcggccctgggaccaatgtgatatacaaacgtaactgtcgtctgcacgatctcgtctntac

SEQ ID NO: 167553 - DNA, 485 bp, Homo sapiens
  misc_feature: GYAE6OF02GPOZ1.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgcctaacagtataagtagttattcaactttcgccctgggaccaatgtgatatcaacgactgtgctgcaccatctgtcttc

SEQ ID NO: 167554 - DNA, 489 bp, Homo sapiens
  misc_feature: GYAE6OF02G2ONJ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagcccctaagctcctgatctatgatgtctccaatatggaaagtggggtcccatcaaggttcagcggcagtggatctgggacagaattcactctcaccatcagcagcctacagcctgatgattttgcgtactttattattgccaacagtataagagttttatctaactttcgccctgggaccaatgtgatagtcaaacgtactgtgctgcaccatctgtcttac

SEQ ID NO: 167555 - DNA, 492 bp, Homo sapiens
  misc_feature: GYAE6OF02H8M9C.16.81.H04.1.454.CMB.1.raw
  modified_base (342)..(342): a, c, t, g, unknown or other
  misc_feature (342)..(342): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcggcagtggatcngggacagaattcatctcaccatcagcagcctacagcctgatgtattttgcgtacttattattgaccaacagttaataagagttattctaactttcggcctagggacctaagtgtagatatcaaacgaactgtgctgcaccatctgtcttc

SEQ ID NO: 167556 - DNA, 489 bp, Homo sapiens
  misc_feature: GYAE6OF02FGHX6.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagtagtttattcaactttcggccctagggaccaatgtgatatacaacgaactgtgctgcaccatctgtcttc

SEQ ID NO: 167557 - DNA, 509 bp, Homo sapiens
  misc_feature: GYAE6OF02I0LVO.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgacgtacttattattgacctaactagtaataagagtttattacaacgtttcggcccttcgggaacctaagtgtggtaatacgtacaaacgaactagtgcgtgcaccatcttgtcttacg

SEQ ID NO: 167558 - DNA, 504 bp, Homo sapiens
  misc_feature: GYAE6OF02IV9M8.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgcctaacagtaataagtagtttaattctaacttttcggccctgggaacccaagttgtggtatagtctaaacgaacttgtggctgcaccatctgtcttac

SEQ ID NO: 167559 - DNA, 584 bp, Homo sapiens
  misc_feature: GYAE6OF02JK4YJ.16.81.H04.1.454.CMB.1.raw
tcagtgtactactccacgaccggtgctcgatttagtagtgtagattcgcgggggtcgagactcagtcaggacacagcatggacatgagggtccccgctcagctcctggggctcctgctgctctggctcccaggtatcaaatgtgacatccagatgacccagtctccttccaccctgtcctgcatctgtcggagacagagtcaccatcacttgccggcagtcagagtgttgacctggttgctggtatcagcagaaccagggaagcccctaagctcctgatctatgatcgtctccaatatagggaaagtcgggtcccatcgagttcagcggcagtggatcgtagggactagaattccgactactacaccactcaacgcacggccctaacgacgaccgtgtacttagtacgtttttgaccgttacttttaattatttacgaccctaaaccgtagttaaacgttaaggtaagttttaatttccgtaaaccttttccggacccgttagggtaacccaagttcgtaggtactataaccgtaaagtaccgttggttaccggctagtaccaccgtaatcgttgttaccttcg

SEQ ID NO: 167560 - DNA, 524 bp, Homo sapiens
  misc_feature: GYAE6OF02IGGK3.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaagcccctaagctcctgatctatgatgtctccaatatggaaagtggggtccatcaaggttcaggcggcagtggatcgtgggacagaattcactctcaccatcagcagcctacagcctgatgtattttcgcgtactttattattcgacctaactagtaataagtagtttaattacctaactttccgggacccttgggaaccctattgtaggattagtacaaacggtactagtcggactgaccaccatcttacgtcttacc

SEQ ID NO: 167561 - DNA, 512 bp, Homo sapiens
  misc_feature: GYAE6OF02F1BKL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtactttattattgacctaactagtaataagtagtttaattctaacgtttcggaccctaggaacctaagtgtaggtatagtacaaacgtaactgtagctcgactacctatctgtcttac

SEQ ID NO: 167562 - DNA, 566 bp, Homo sapiens
  misc_feature: GYAE6OF02HLRQ0.16.81.H04.1.454.CMB.1.raw
  modified_base (415)..(415): a, c, t, g, unknown or other
  misc_feature (415)..(415): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcgaaggttcagcggcagtggatcgtgggacagaattcactctcaccatcagcagcctacagcctagatgtattttgctacttattattgaccaaanagtaataaagtaacgtttattacctaaccgttttccggccccgttagggtaaccctaagttcggttagggtaattaacgtaacgtaaaccgtaacgttggttacggtacttacggacctaacccgtaacgttccttcggttacctttaccg

SEQ ID NO: 167563 - DNA, 486 bp, Homo sapiens
  misc_feature: GYAE6OF02G7TFJ.16.81.H04.1.454.CMB.1.raw
  modified_base (378)..(378): a, c, t, g, unknown or other
  misc_feature (378)..(378): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacngcctgatgattttgctacttattattgaccaacagtataagagtttattctaactttcgccctggacctatgtgatagtcaaacgatgtaggctgcacatctgtcttc

SEQ ID NO: 167564 - DNA, 518 bp, Homo sapiens
  misc_feature: GYAE6OF02HMOKR.16.81.H04.1.454.CMB.1.raw
  modified_base (272)..(272): a, c, t, g, unknown or other
  misc_feature (272)..(272): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaaccagggaaancccctaaagctcctgatctatgatgtctccaatatggaaagtggggtcccatcaaggttcagcggcagtggatcgtgggacagtaattcactctcacatcagcagcctacagcctgatgtattttgcgtactttattatttcgcctaaacagttaataagtagtttattactaactttccggccctagggaccaattgtaggattatacaaacgtaactgtaggcgtcgacacctacttctgttcc

SEQ ID NO: 167565 - DNA, 549 bp, Homo sapiens
  misc_feature: GYAE6OF02GUDEZ.16.81.H04.1.454.CMB.1.raw
  modified_base (275)..(275): a, c, t, g, unknown or other
  misc_feature (275)..(275): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaancccctaagctcctgatctatgatgtctccaatatggaaagtggggtcccatcaaggttcagcggcagtggatcgtgggacagaattcactctcaccatcagcacgcctacacgtcctgaacttgtattttcgacgtaactttatttaattcgacctaaactagtaataaagtagtttatttacctaaacgttttccgggcccgttagggtaccctaagttcggtaggtaatacgtaacaaacgtactggtacggcttagacctaccgtattccg

SEQ ID NO: 167566 - DNA, 539 bp, Homo sapiens
  misc_feature: GYAE6OF02H6NPK.16.81.H04.1.454.CMB.1.raw
  modified_base (353)..(353): a, c, t, g, unknown or other
  misc_feature (353)..(353): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctccaatataggaaagtgggtacccatcaaggttcaggcggcaggtggatcgtggacngaattcactctcaccatcagcacgcctacagcctagatgtattttgacgtacttattattcgacaactagtaataaagtatttaattctaaccgttttcggacccttaggaacctaagtagtaggtaattacgtactaaacgtactggtacggtacgtacgacctacctactcttcgtaccttacg

SEQ ID NO: 167567 - DNA, 568 bp, Homo sapiens
  misc_feature: GYAE6OF02GQZWS.16.81.H04.1.454.CMB.1.raw
tcagtgtactactccacgaccggtgctcgatttagtagtgtagattcgcgggggtcagactcagtcaggacacagcatggacatgagggtccccgctcagctcctggggttcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagtggcagtggatcgtgggacagaattcactctcaccatcagcagcctacacgcctgattgtattttgacgttactttattattcgacctaactagttaataaagtagtttactttactaaacgttttccggacccttacggggaacctaagttggtaggtattaacgtaccgaaaacggtaacgttcggtacgggtaccttacggacctaaccgtattaccgttgttacctttactacc

SEQ ID NO: 167568 - DNA, 500 bp, Homo sapiens
  misc_feature: GYAE6OF02FP2QL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatcgtgggacagaattcactctcacatcagcagcctacagcctgatgattttgcgtactttattattgcctaacagttataagagtttattctaactttcggccctgggacctaagtgtaggatatcaaacgaactgtaggctgctaccatctcgtcttac

SEQ ID NO: 167569 - DNA, 565 bp, Homo sapiens
  misc_feature: GYAE6OF02GZFEG.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatataggaaagtgggtcccatcaaggttcagcggcagtggatcgtgggacagaattcactctcacatcagcagcctacagcctgatgtattttgcgtactttattattcgacctaactagttaataagtagtttaatttacgtaaccgttttccggacccgttagggaacctaagttcggtaggtaattaacgtaaccgtaaaacggtaacgttggtacgggtaccttacggaccctaacctacgttccgttacgttcctttaccg

SEQ ID NO: 167570 - DNA, 493 bp, Homo sapiens
  misc_feature: GYAE6OF02I35RH.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatcgtgggacagaattcgactctcaccatcagcagcctacagcctgatgattttgcgtacttattattcgcctaacaagtataagtatttattcaactttcggccctggaccatgtagatatcaaacgatgtaggctcgcaccatctgtcttac

SEQ ID NO: 167571 - DNA, 483 bp, Homo sapiens
  misc_feature: GYAE6OF02HFTVX.16.81.H04.1.454.CMB.1.raw
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcggcagtggatctgggacagaattcactctcaccatcagcagcctacagcctgatgattttgcgtacttattatgaccaanagtataagattattctaactttcgcctggaccaagtgtagatagtcaaacgactgtgntgcaccatctgtctc

SEQ ID NO: 167572 - DNA, 500 bp, Homo sapiens
  misc_feature: GYAE6OF02JHZ4D.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtccatcaaggttcagcggcagtggatcgtgggacagaatcactctcacatcagcagcctacagcctagatgatttgcgtacttatattgaccaactagtataagtagttattactacgtttcgcccttggacctaagtgtagtatagtacaaacgacgtgtgactcgaccacctagtctgttcttac

SEQ ID NO: 167573 - DNA, 488 bp, Homo sapiens
  misc_feature: GYAE6OF02GZY0L.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgattgattttgcgtacttattattgccaacagtataagagttattcaactttcggcctgggaccaatgtggatatcaaacgaatgtaggctgcaccatcg

SEQ ID NO: 167574 - DNA, 497 bp, Homo sapiens
  misc_feature: GYAE6OF02HDICW.16.81.H04.1.454.CMB.1.raw
  modified_base (398)..(398): a, c, t, g, unknown or other
  misc_feature (398)..(398): n is a, c, g, or t
  modified_base (479)..(479): a, c, t, g, unknown or other
  misc_feature (479)..(479): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaagcccctaagctcctgatctatgatgtctccaatataggaaagtgggtaccatcgaaggttcagcggcagtggatcgtgggacagaattcactctcaccatcagcagcctacacgcctgatgtattttgntactttattattgaccaatagtataagtatttatctaactttcgacctggaccatgtagtatatacaaacgtactgtacgntcgcactatctgtcttac

SEQ ID NO: 167575 - DNA, 539 bp, Homo sapiens
  misc_feature: GYAE6OF02HS40I.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatcgtgggacagaattcactctcaccatacaacagcctacacgcctgatgtattttgcgtacttattatagacctaacagttataaagtagtttaacttactaaccgttttcggaccccttagggtaaccctaagtcggttaggaattacgtacaaacgtaacttggtacggtctacggaccacctatcttacg

SEQ ID NO: 167576 - DNA, 564 bp, Homo sapiens
  misc_feature: GYAE6OF02IDQ0N.16.81.H04.1.454.CMB.1.raw
tcagtgtactactccacgaccggtgctcgatttagtagtgtagattcgcgggggtcgggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctccaatatggaaagtggggtccctatccaaggttcagcggcagtggatcgtgggacagaattcactctaccacatcagcagcctaacgagcctgattgtattttgcggttactttatttattacgacctaaacagttaactaaagttagtttaattacgtaactttccgggtacccttgggtaccctaagtcgttaggtagtactaacgaaaccgtaacgtaggtacggtacgtagtacaccgtagtcttcggttaccttactaccg

SEQ ID NO: 167577 - DNA, 514 bp, Homo sapiens
  misc_feature: GYAE6OF02GZS7N.16.81.H04.1.454.CMB.1.raw
  modified_base (495)..(495): a, c, t, g, unknown or other
  misc_feature (495)..(495): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaagcccctaagctcctgatctatgatgtctccaatataggaaagtggggtcccatcaaaggttcaaggcggcagtggatcgtgggacagaattcactctcaccatcagcagcctacagcctgatgtattttgacgtactttattattgacctaaacagttaataaagtagtttattactaaacgtttcgaccctggaaccaatgtagataagtacaaacgtaactgtagntacgcaccatctgtcttac

SEQ ID NO: 167578 - DNA, 496 bp, Homo sapiens
  misc_feature: GYAE6OF02HJ07E.16.81.H04.1.454.CMB.1.raw
  modified_base (269)..(269): a, c, t, g, unknown or other
  misc_feature (269)..(269): n is a, c, g, or t
  modified_base (421)..(421): a, c, t, g, unknown or other
  misc_feature (421)..(421): n is a, c, g, or t
  modified_base (470)..(470): a, c, t, g, unknown or other
  misc_feature (470)..(470): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaancccctaagctcctgatctatgatgtctccaatatggaaagtggggtccatcaaggttcaggcggcaggtggatgtgggacagaattcactctcaccatcagcagccctaacgagtcctgattgtattttgcgtactttattattgacccaanagtaataagtatttacttcgtaacttcggacctggaacctatgtgatanacaactatgtgctgcacatctntntc

SEQ ID NO: 167579 - DNA, 555 bp, Homo sapiens
  misc_feature: GYAE6OF02G4JWO.16.81.H04.1.454.CMB.1.raw
tcagtgtactactccacgaccggtgctcgatttagtagtgtagattcgcgggggcaggagtcagactcagtcaggacacagcatggacatgagggtcccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatatggaaagtgggtccatcaaggttcagcggcagtggatcgtgggacagaattcactctacacatcagcagcctacagcctgattgtattttgcgtactttattattcgacctaaactagtaacttaaaggagtttaattaccgtaaacgttttaccggacccttaggggtaccctaagttcggtacgggtaattaacgtaacctaaaacggtaacgttaggttacggaccttggacctaccgtattaccg

SEQ ID NO: 167580 - DNA, 512 bp, Homo sapiens
  misc_feature: GYAE6OF02ITCY4.16.81.H04.1.454.CMB.1.raw
  modified_base (225)..(225): a, c, t, g, unknown or other
  misc_feature (225)..(225): n is a, c, g, or t
tcagtgtactactccacgaccggtgctcgatttagtagtgtagattcgcggggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagngtgttggtacctggttggcctggtatcagcagaaaccagggaaagcccctaagctcctgatctatgatgtctccaatagtggaaagtcggggtccatcaaggttcaggcggacaggtggatctgggacagaattcactctcaccatcagcagcctacagcctgactgtattttgcgtacttaattattgacctaacagtataagtattattactaactttcgccgttggacctagtgtagtatatacgaaagaacgtggtcggctgactacactctcgttcttctac

SEQ ID NO: 167581 - DNA, 508 bp, Homo sapiens
  misc_feature: GYAE6OF02FZ0W1.16.81.H04.1.454.CMB.1.raw
  modified_base (419)..(419): a, c, t, g, unknown or other
  misc_feature (419)..(419): n is a, c, g, or t
tcagtgtactactccacgaccggtgctcgatttagtagtgtagattcgcggggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccagtcaaggttcagcggcagtggatcgtgggacagaattcactctcaccatcagcagcctacagcctgatgtatttgacgttactttattattcgacctaanagtaataagtagttattactaacgtttcggacctgggactaagtgtaggatactacgtaaacgatgtgtctgcacatctcgttctctac

SEQ ID NO: 167582 - DNA, 528 bp, Homo sapiens
  misc_feature: GYAE6OF02GCS6M.16.81.H04.1.454.CMB.1.raw
  modified_base (412)..(412): a, c, t, g, unknown or other
  misc_feature (412)..(412): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctcaatatggaagtgggtccatcaaggtcagcggcagtggatcgtggacagaattcactctcacatcagcagcctacagcctgatgtattttgcgtactttattattcgacctaaanagttaataagtagtttaattcctaaccgtttccggacccttagggaacctaagtggttaggaactaagtacgaaacgtaacgtgtacggactcgactacctattcttgtaccttac

SEQ ID NO: 167583 - DNA, 557 bp, Homo sapiens
  misc_feature: GYAE6OF02IK7WU.16.81.H04.1.454.CMB.1.raw
  modified_base (381)..(381): a, c, t, g, unknown or other
  misc_feature (381)..(381): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagccctaagctcctgatctatgatgtctccaatataggaaagtggggtacccagtcaaggttcagcggcgagtggatcgtgggacagaattcactctcaccatcagcagcctanagtcctgactgtatttcgactacgtttattattcgacaactagtaataagtagttattacaaccgttttcggacccgttacgggaacctaagtacgtacgggtaattacgtaacctaaacgtaactaggtcgggtacgttacggacctaacctaagttcgttacgttactttaccc

SEQ ID NO: 167584 - DNA, 512 bp, Homo sapiens
  misc_feature: GYAE6OF02FLQ1L.16.81.H04.1.454.CMB.1.raw
tcagtgtactactccacgaccggtgctcgatttagtagtgtagattcgcggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaccagggaacgcccctaagctcctgatctatgatgtctccaatataggaagtgggtccatcaagtcagcggcagtggatctggacagaatttttttcactctcaccatcagcagcctacacgcctgatgtatttgtcgtacttattattagaccaacagtaataagtagttattactaactttacggtcccgtacggtaccgtaatagtaggtatatactaaacgaactagtggtctgcaccatctcgtcttctac

SEQ ID NO: 167585 - DNA, 526 bp, Homo sapiens
  misc_feature: GYAE6OF02IJ1P9.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaagcccctaagctcctgatctatgatgtctccaatatggaaagtggggtcccatcaaggttcagcggcagtggatcgtgggacagtaatcactctacaccatcagcagcctacagcctagatgtaattttgacgttactttattattcgacctaacagtaataaagtagtttattactaacgtttcgacccttagggacctaaagtgtacggtatacgtacaaacgtaactgtaggtctagacactatctgttctactacc

SEQ ID NO: 167586 - DNA, 640 bp, Homo sapiens
  misc_feature: GYAE6OF02HF5KT.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggagtcagactcagtcaggacacagcatggacatgagggtccccgctcagctcctgggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcagaaaccgagggaacncccctaagcctcctgactctatgatcgtctacctaagtagtaggtaaagtcgggtacccagtacgtaaggttcaggcggtactaggttcggatcgtaggtacgagtaacgtactaccgtacctccgtaaccacttacacgacgaccgtaccgtacctaacgtacctacgtagtacgttagtttccgtacgttaacctttactttacttacgtcctaaacgtaacgttaagtaagttacgttacgttaccggtcggttaccgggttaccgtaccgggtaaccggacggtacgggtaggtaccgtaacgtaaccgtaaacggtaacgttacggtacggtcgtacgtacgtacccgtagtacgttccgttacg

SEQ ID NO: 167587 - DNA, 500 bp, Homo sapiens
  misc_feature: GYAE6OF02HOF6L.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatacaaggttcgtagcggcagtggatcgtagggacgagaattacactctcaccactcagcagcctacagcctcgatgatttgtcgactttattattgtccaacagtaataagagttattctaacttcgtccgtcggtacatgtggtataatacaacgaactagtgcgtagcacatctgtc

SEQ ID NO: 167588 - DNA, 515 bp, Homo sapiens
  misc_feature: GYAE6OF02ITLY6.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaagtgggtccatcaaggttcagcggcagtggatcgtgggacagaattcactctcacatcagcagcctacagcctgattgtattttgacgtactttattattcgaccaatagttataagtagtttattacctaacgtttccggaccctgggaacctaagttgtaggattatacgtaaacgactggtagctacgcctaccatcttcgtcttc

SEQ ID NO: 167589 - DNA, 595 bp, Homo sapiens
  misc_feature: GYAE6OF02JFWVX.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagccccctaagctcctgatctatgatgtctccaatatggaaagtgggtcccatcaaggttcagcggcagtggatcgtgggacagaattcactctcacatcagcagcctacagcctgatgattttggacgtacttattacttgacctaacgaagtaattaaagtaacggtttaatttaccgttaaaccgtttttccgggaccccgttaggggtaaaccctaaagttacggttagggtaaattaacgttaaccgtaaaaaccggtaaacttacgggttacggtaccgttacggacctaacccgtaatttccgttacgtttaccgtttaccg

SEQ ID NO: 167590 - DNA, 556 bp, Homo sapiens
  misc_feature: GYAE6OF02IDMOR.16.81.H04.1.454.CMB.1.raw
  modified_base (191)..(191): a, c, t, g, unknown or other
  misc_feature (191)..(191): n is a, c, g, or t
  modified_base (335)..(335): a, c, t, g, unknown or other
  misc_feature (335)..(335): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccgggcagtcagagtgttggtacctggttggcctggtatcagcagaaaccagggaaagccctaagctcctgactctatgatgtctccaatatggaaagtgggtacccatcgaaggttcaagcggnagtggatcgtggacagaattgactctcacatcagcagcctacagcctgactgtattttgcgtacttattattgaccaacagtataaagtagtttaacttctaacgttttccggacccttagggaaccctaagttgttacgggaatttaacgtactaaaaccggaaaccgttggttacggtacgtacggtacctaaccctaagtccgttacgtcgtttaacc

SEQ ID NO: 167591 - DNA, 499 bp, Homo sapiens
  misc_feature: GYAE6OF02FZ6UI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcggcagtggatctgggacagaattcactctcaccatcagcagcctacagcctgatgattttgcgtactttattattgcctaacagtaataagtagttaattactaacttttcgccctgggaacccaatgtaggatatacaaacgtaactgtgctgcaccatcttgtcttc

SEQ ID NO: 167592 - DNA, 511 bp, Homo sapiens
  misc_feature: GYAE6OF02H9SMU.16.81.H04.1.454.CMB.1.raw
  modified_base (274)..(274): a, c, t, g, unknown or other
  misc_feature (274)..(274): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgccatctgtcggagacagagtcaccatcacttgccgggcagtcagagtgtgtacctggttggcctggtatcagcagaaaccagggaaacncccctaagctcctgatctatgatgtctccaatagtaggaagtgggtcccattcaaggttcagcggcagtggatcgtggacagaattcactctcaccatcagcagcctaacgacgcctgattgtatttgcgtatttattattcgactaacagtataagtagttattcactttcggcctaggacctaagtcgtagtatactacgaacgtaacgtggtacggctacgacctaccattccg

SEQ ID NO: 167593 - DNA, 483 bp, Homo sapiens
  misc_feature: GYAE6OF02FJIQS.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagagttattcaactttcggcctggaccagtgtgatatacaacgaactgtgctgcacatctgtcttc

SEQ ID NO: 167594 - DNA, 541 bp, Homo sapiens
  misc_feature: GYAE6OF02F64U5.16.81.H04.1.454.CMB.1.raw
  modified_base (380)..(380): a, c, t, g, unknown or other
  misc_feature (380)..(380): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaacgcccctaagctcctgactctatgatgtctccaatatggaaagtggggtccatcgaaggttcagcggcagtggatcgtgggacagaattcactctcaccatcagcagcctacngcctgactgtattttgaccgttaactttattattcgacctaacaagttataaagtagtttattactaacgtttccgggcccttagggaacctagttgtaggtataacgtacgaaacgtaacgtggtacggtctacgacacctattctcgttccttataccg

SEQ ID NO: 167595 - DNA, 508 bp, Homo sapiens
  misc_feature: GYAE6OF02H03AZ.16.81.H04.1.454.CMB.1.raw
  modified_base (380)..(380): a, c, t, g, unknown or other
  misc_feature (380)..(380): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctccaatataggaaagtgggtcccatcaaggttcagcggcagtggatcgtgggacagaattcactctcaccatcagcagcctacngctgatgtattttgcgtatttattattcgcaactagtataagtagtttattactaactttcggaccctagggaccaagttgtagtatatacaacggtaactggtcgcgtgcctaccatcttgtcttac

SEQ ID NO: 167596 - DNA, 509 bp, Homo sapiens
  misc_feature: GYAE6OF02ILHZN.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaagcccctaagctcctgatctatgatgtctccaatatggaaagtgggtacccatcaaggttcagcggcaggtggatcgtgggacagaattcaactctcacctatcagcacgcctacagcctgatgattttgctacttattattgaccaatagtaataagtagttattactactttccggcccttagggacctaagttgtaggtatagtacaaacgtactgtagtctgcacctatctgtcttacc

SEQ ID NO: 167597 - DNA, 530 bp, Homo sapiens
  misc_feature: GYAE6OF02JDYUY.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctcaatatggaaagtggggtccatcaaggttcagcggcagtgatcgtggacagaattcactctcaccatcagcagcctacagcctgattgtattttcgcgtaactttattattgacctaactagtaataaagtagtttaacttacctaaccgtttccggacccgttagggaccctaagttggtaggtaatacgtacaaacgtacgtgtggacctggacctaccgtattcg

SEQ ID NO: 167598 - DNA, 536 bp, Homo sapiens
  misc_feature: GYAE6OF02HU89F.16.81.H04.1.454.CMB.1.raw
  modified_base (392)..(392): a, c, t, g, unknown or other
  misc_feature (392)..(392): n is a, c, g, or t
tcagtgtactactccacgaccggtgctcgatttagtagtgtagattcgcgggggtcagactcagtcaggacacagcatggacatgagggtccccgctcagctcctgggggctcctgctgctctggctcccaggtatcaaatgtgacatccagatgacccagtctccttccacctgtctgcatctgtcggagacagagtcaccatcacttgccgggccagtcagagtgttggtacctgggttggcctggtatcagcaagaaaccagggaaacgcccctaagctcctgatctatgatgtctaccaatagtaggaaaggtcgggtccatcgtaaggttcagcggcaggtggatcgtagggacagtaattcactctacacatcagcacgcctaacngctagatgtatttgacgttattatttattcgaccaataagtagtaagtagttattactaacgtttcgtacccgtagggaacctaagtgtaggtatacgtaacaaacgtacgtagtaggacttcgactaccgattctgtcttacg

SEQ ID NO: 167599 - DNA, 536 bp, Homo sapiens
  misc_feature: GYAE6OF02IECY2.16.81.H04.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (532)..(532): a, c, t, g, unknown or other
  misc_feature (532)..(532): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcgganacagagtccaccatcacttggccgggccagtcagagtgttggtacctggttggcctggtatcagcagaaaccagggaancccctaagctcctgatctatgatgtctccaatataggaaagtcgggtccagtcaaggttcaggcggnaggtgatcgtgggacagaattcactctacacctatcagcagcctacacgcctgtatgtattttcggacttactttattacttgacctaaactagtaattaaaggtatttaactttactaaacgtttcgcccgttagggtacctaagttggtggtacttagtacaaacgtactggtcggtctagcacctntccg

SEQ ID NO: 167600 - DNA, 644 bp, Homo sapiens
  misc_feature: GYAE6OF02G7JJE.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagtagtgttggtacctggttgcctggtatcagcaagaaaccagggaaacgcccctaagctcctgatctatgatgtctaccaatagtaggaaagtcggggtaccagtacaaggttcaaggcggctaggtggactcgtacgggaactaaggtaacttcgaactctaccaacctagtaccaaggccacgtaccctacgtacgacctggtaattgtacttttcggaccttacttttaacgtttattaccgtacctaaacgtaagttaacgttaaagttacgttttaactttacgttaaaccgttttccgggtacccgtagggtaaccctaagttacgtaggtaacttaacgtaaacgttaaaccggtaaaccgttggttacggtaccgtacgtacccgtaaccttacgttcgttcggttaccctttacg

SEQ ID NO: 167601 - DNA, 553 bp, Homo sapiens
  misc_feature: GYAE6OF02HB2UI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtccatcaaggttcagcggcagtggatcgtggacagaattcactctcaccatcagcagcctacagcctgatgtattttgcgtactttattattgacctaaactagtaactaagtagtttattactaacgttttccgggacccttaggggaacctaagttcggtaggtaattaacgtaccaaaacggtaacttggttacggcttacggacctaaccctatttaccgttcgttacctttaccg

SEQ ID NO: 167602 - DNA, 591 bp, Homo sapiens
  misc_feature: GYAE6OF02JP1M1.16.81.H04.1.454.CMB.1.raw
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaacgcccctaagctcctgatctatgatgtctaccaatataggaaagtcggggtaccagtacaaggttcagcggcagtggatcgtgggacagtacttcactctacacatcagcancctanacgctgattgtatttcgcgttatttattacttacgacctaaacgtagttaataagttagtttacttaccgtaacgttttcccggacccgtagggtaacccctaagttacggtacggtaacttaacgtaaccgtaaacgtaacgttacgggtacggtacgttaccggtacctaacccgtagtttacccgttgtttacccgtttaccg

SEQ ID NO: 167603 - DNA, 538 bp, Homo sapiens
  misc_feature: GYAE6OF02JYTV3.16.81.H04.1.454.CMB.1.raw
  modified_base (296)..(296): a, c, t, g, unknown or other
  misc_feature (296)..(296): n is a, c, g, or t
  modified_base (426)..(426): a, c, t, g, unknown or other
  misc_feature (426)..(426): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccacctgtctgcatctgtcggagacagagtcaccatcacttgccgggcagtcagagtgttggtacctggttgcctggtatcagcagaaccaggaagccctaagctctagatctatgatgtctcaatagnggaaagtgggtaccagtacgaaggttcagcggcagtgatcgtagggacagaattcgaactctacaacctatcagcacgcctacgacgtctagatgtagttttgacgttactttagttacttgacctaaanacgttaataagtacgttattacgtaacgttaccgaccttgggaactaagtcgtagatatacgaaacgtactggtacggacttggactaacgtactcgttcgtacttcgtaac

SEQ ID NO: 167604 - DNA, 509 bp, Homo sapiens
  misc_feature: GYAE6OF02G4CNF.16.81.H04.1.454.CMB.1.raw
  modified_base (380)..(380): a, c, t, g, unknown or other
  misc_feature (380)..(380): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatcgtgggacagaattcactctcacatcagcagcctacncgcctgatgtatttgcgttacttattattgacctaactagtaataagtattattactaactttccggccgtaggacctaagtgtagtatatactaaacgtaactagtggctagaccaccattctgttcc

SEQ ID NO: 167605 - DNA, 526 bp, Homo sapiens
  misc_feature: GYAE6OF02HHT01.16.81.H04.1.454.CMB.1.raw
  modified_base (268)..(268): a, c, t, g, unknown or other
  misc_feature (268)..(268): n is a, c, g, or t
  modified_base (342)..(342): a, c, t, g, unknown or other
  misc_feature (342)..(342): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttgcctggtatcagcagaaaccagggaaacncccctaagctcctgatctatgatgtctaccaatatggaaagtcggggtaccatcaaggttcagcgcagtgatcnggacagaattcactctcaaccatcagcagcctacagtcctagacttgtaattttgacgttaactttagttacttacgacctaaacagtaataaagtagtttaattctaaacctttcggacccttagggacctaagtgtaggatatacgaaacgactgtcggactgcacattgtcgttctactac

SEQ ID NO: 167606 - DNA, 551 bp, Homo sapiens
  misc_feature: GYAE6OF02I2NHM.16.81.H04.1.454.CMB.1.raw
  modified_base (334)..(334): a, c, t, g, unknown or other
  misc_feature (334)..(334): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgtggtacctggttggcctggtatcagcagaaaccagggaaagcccctaagctcctgatctatgatgtctccaatataggaaagtgggtaccatcgaaggttcagcggnaggtggatcgtgggacagaattcactctcaaccatcagcacgcctacagtcctgattgtattttgacgtactttattattcgacctaactagtaataaagtagtttatttaccgtaacgttttccgggacccgttagggtaacctaagttcggtagtattaacgtaacgaaaacgtactaggtcggacttacgacctacctatcttacgtcttaccg

SEQ ID NO: 167607 - DNA, 557 bp, Homo sapiens
  misc_feature: GYAE6OF02GXSZT.16.81.H04.1.454.CMB.1.raw
  modified_base (269)..(269): a, c, t, g, unknown or other
  misc_feature (269)..(269): n is a, c, g, or t
  modified_base (341)..(341): a, c, t, g, unknown or other
  misc_feature (341)..(341): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttgtacctggttggcctggtatcagcagaaaccagggaaacncccctaagctcctgatctatgatgtctccaatagtaggaagtgggtccatcaagttcagcgcagtggatcgnggacagaattcactctacacatcagcacgacctacacgcctgatgtatttgacgtacttattacttcgaccaagtagtaataagtagtttacttacgttaacgtttccggtacccgttagggtaaccctaagttcggttacgtaattaacgtaacgtaaaaccgtacgttaggtacggtacgtacggcctaaccgtacgttcgttcgtacttaccg

SEQ ID NO: 167608 - DNA, 573 bp, Homo sapiens
  misc_feature: GYAE6OF02HYEO6.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccgagggaaagcccctaagctcctgatctatgatgtctccaatatggaaagtcgggtaccagtacgaaggttcaggcggcgaggtggatcgtagggacagaacttcaactctacaccatacgagacacgcctacagcctgatgttatttcgacgttactttattattacgacctaaagtagttaagttaagtagtttaacttaccgtaacgttttccgggacccgttaggacctaagttcggtaggtatacgtaacaaaccggtacgttaggtacggtcttacgaccgtaacctagttcctcgttccttaaccg

SEQ ID NO: 167609 - DNA, 569 bp, Homo sapiens
  misc_feature: GYAE6OF02IXCXL.16.81.H04.1.454.CMB.1.raw
  modified_base (334)..(334): a, c, t, g, unknown or other
  misc_feature (334)..(334): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcgganaggtggatcgtggacagaattcactctcaccatcagcaggcctacagcctgactgtattttgacgtactttattattagacctaactagttaacttaaagtagtttaactttcaaacgttttccggtacccgtacgggtaacctaagttggttaggaattacgtaacctaaaacggtaaccttggtacgggtctttacggaccgtaaccctattccgttcggttcctttaacccg

SEQ ID NO: 167610 - DNA, 561 bp, Homo sapiens
  misc_feature: GYAE6OF02I7NBK.16.81.H04.1.454.CMB.1.raw
  modified_base (278)..(278): a, c, t, g, unknown or other
  misc_feature (278)..(278): n is a, c, g, or t
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
tcagtgtactactccacgaccggtgctcgatttagtagtgtagattcgcgggggcgagggagtcagactcagtcaggacacagcatggacatgagggtccccgctcagctcctgggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacncccctaagctcctgatctatgatgtctccaatatggaaagtgggtccatcaaggtcagcgnagtggatgtgggacagtaattcatctacaccatacagcagcctaacancctanattgttaatttcgacgtaactttagttacttgacctaaactagttaataaggttaatttaagtttaccttaaaccgttttcggaccccgttagggtaacctaagttaggtaggtaacttagtaaccaaaccggtaagtgtacgggtcttacggacctaccgtattaccg

SEQ ID NO: 167611 - DNA, 564 bp, Homo sapiens
  misc_feature: GYAE6OF02IUL0H.16.81.H04.1.454.CMB.1.raw
  modified_base (359)..(359): a, c, t, g, unknown or other
  misc_feature (359)..(359): n is a, c, g, or t
tcagtgtactactccacgaccggtgctcgatttagtagtgtagattcgcgggggtcgagactcagtcaggacacagcatggacatgaggtccccgctcagctcctggggctcctgctgctctggctcccaggtatcaaatgtgacatccagatgaccagtctccttccacctgtctgcatctgtcggagacagacgtcaccatccacttgcccgggcaagtcagagtgttggaccgtggttggcctggtatcgagcagaaaccgaggaaagccctaagctcctgatctatgatgtcacaatagtaggaaaggttgggtcctatacgtaaggttcaggtcggacaggtcgattcgagganagaattcgactctcacgatcgagcaggtaccctacacgcctgagtcgttattttcggacgtaacttttagttacgttcgaccaaacgtagttaagaaccgttagttactttacgtaaccgttttcggccttagggaccttaagtcgtagtatcgtaaccgaaagttacgtcgtacgctaggcccaacttagtcttacgttcgtac

SEQ ID NO: 167612 - DNA, 573 bp, Homo sapiens
  misc_feature: GYAE6OF02H0CXT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaagcccctaagctcctgatctatgatgtctccaatatggaaagtgggtacccatcgaaggttcagcggcaggtggatcgtgggacagaattcactctcaccatcagcagcctacagtcctgattgtattttcgcgttactttattattcgacctaactagtaataagtagtttattacctaacgtttccggacccgttagggaaccctaagttcggttaggtaacttaacgtaaccgtaaaccggtaacgttaggtacgggtaccttacggaccctaacccgttaattccgttacggttacctttaccg

SEQ ID NO: 167613 - DNA, 554 bp, Homo sapiens
  misc_feature: GYAE6OF02I32HZ.16.81.H04.1.454.CMB.1.raw
  modified_base (191)..(191): a, c, t, g, unknown or other
  misc_feature (191)..(191): n is a, c, g, or t
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (425)..(425): a, c, t, g, unknown or other
  misc_feature (425)..(425): n is a, c, g, or t
  modified_base (515)..(515): a, c, t, g, unknown or other
  misc_feature (515)..(515): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccgggccagtcagagtgttggtacctggttggcctggtatcagcaagaaaccagggaagcccctaagctacctgatctatgatgtctccaatanggaaagtgggtccatcaaggttcagcgnagtggatntggacagattcactctcacatcancagcctagacnctgatgtatttgacgtactttattattcgacctaatagtaattaacggtntttaactttactaaccttttccgggacccttagggaaaccctagttacggtagtaactacgtaaccgtaaaacggtacgtggtacgggtnttacggcctaacccgtagtttccgttcgttaccgttacc

SEQ ID NO: 167614 - DNA, 521 bp, Homo sapiens
  misc_feature: GYAE6OF02HSGRO.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcaggcgcgagtgggatctgggacaggaattcactctcaccatcagcagcctacagcctgatgattttgcgtacttattattgtccaacagttaataagagtttaattactaacttttcgggcccttacgggtaccaacgttgtaggtagtataccaaacgtaacctaggttggctcggcctccgactctgtc

SEQ ID NO: 167615 - DNA, 614 bp, Homo sapiens
  misc_feature: GYAE6OF02HY5RJ.16.81.H04.1.454.CMB.1.raw
tcagtgtactactccacgaccggtgctcgattttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccgagggaaacgcccctaagctcctgatctatgatgtcctacaatagtaggaaacggtcgggtcccaatacgtaaggttcaggcggacgaggtggacgtcgtagggaacagtaacttcaccttctaccactagtcacgcacgacctacgcgcctagagttagttattttcggacgttaactttagttactacgaacaactagttaaactaagttacgtttaacttaccgttaacgtttccgggacccgttagggaaccttaagttcgttaaggaacttaacgtaaccgtaaaccgttagtcggtacgtaccgtcggtaccctacgtaactttcgtttacgttacctttaccg

SEQ ID NO: 167616 - DNA, 532 bp, Homo sapiens
  misc_feature: GYAE6OF02IS57E.16.81.H04.1.454.CMB.1.raw
  modified_base (380)..(380): a, c, t, g, unknown or other
  misc_feature (380)..(380): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgaccccagtctccttccaccctgtctgcatctgtcggagacagagtcaccatcacttgccgggccagtcagagtgttggtacctggttggcctggtatcagcagaaaccagggaaacgccctaagctcctgatctatgatgtctccaatataggaaagtgggtaccatcgaaggtcagcgcagtggatcgtgggacagtaacttcactctcacatcagcagcctacngcctgatgtatttggctatttattattgaccaatagtataagtatttattcgtaactttcggaccctagggtaaccagttcgtagggaatacgtacgaaaccgtagttacggttgcgttacgaccgtaccgtagtaccttggttcccttacg

SEQ ID NO: 167617 - DNA, 541 bp, Homo sapiens
  misc_feature: GYAE6OF02IGRP0.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctaccaatataggaaagtgggtacccagtcaaggttcaggcggcaggtggatcgtagggacagaattcactctacacatcagcacgtccctacgagcctgattgtattttgacttactttatttattagaccaaactagttaattaaagtaagtttattacgtaacgttttccggacccgtagggaacctaagttcgtaggtatacgtaacaaacgtactggtagctagccacctatctcgtcttac

SEQ ID NO: 167618 - DNA, 587 bp, Homo sapiens
  misc_feature: GYAE6OF02IEGH3.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcgccggccagtcagagtgttggtacctggttggcctggtatcagcaagaaacagggaaagcccctaagctcctgatctatagatgtctaccaatataggaaagtcggggtacccagtctaaggttcaggccggactaaggtggactcgtagggaacacggtaattccactctacaaccgatcgaagcaacgtacctaacagtcctagtatagttattttggacctactttatttacgttagcccaaaagtgttaaataagtagtttaacttcttaaaccgtttccgggccctaagggaaccctaagtacgtaggtaattacgtaacgaaacgtacgtaggttggactcgtaccgtacctattacgttctacgttaccg

SEQ ID NO: 167619 - DNA, 501 bp, Homo sapiens
  misc_feature: GYAE6OF02GN771.16.81.H04.1.454.CMB.1.raw
  modified_base (413)..(413): a, c, t, g, unknown or other
  misc_feature (413)..(413): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttggcctggtatcagcaagaaaccagggaaacgcccctaagctcctgatctatgatgtctccaatataggaaagtcgggtccatcaaggttcagcgcagtggatcgtgggacagtaatcactctcacatcagcagcctacacgcctgatgtatttgcgttattattattgacctaanagtataagtagttattactaactttcggcctagggacctagtgtaggatagtacaaacgtactgtagctacgctaccatctgtcttac

SEQ ID NO: 167620 - DNA, 807 bp, Homo sapiens
  misc_feature: GYAE6OF02HKI8A.16.81.H04.1.454.CMB.1.raw
tcagtgtactactccacgaccggtgctcgatttagtagtgtagattcgcggggggtctagacgtcagtcaggaccacagcatggacactgaggggtccccgctcagctcctggggctcctgcctgcgtctggcttcccaggtatcaaatgtcgacatccagtagtcgacccacgtcgtcccttcccaacccgtggtctggctagttctgtcggagtactagagtcacctagtcacttgcccgggactagtccagagtcgttcggtaccgtgggttcggtcctggttattcgagcaacgaaaccgtacgggaaacgaccccctaagccttaccgtagtacttcgtactaggtaacttcggtaccctaccgtaactagtacgggaaaacggttccggggtacccaagtaccggtaaacggttacgaacggtccggtacgtaggtacggtaacgttccggtaaggggtaacttaggtaacgtttacgtaaccttaccgttacctaccgtaacttccggacggtacccgtaacgggtaccccttacggaccgtacccgttaggtacttcggttacgttttcccggaaccgttaaccgttttaacgttacctttacggaccccgttaaacccgttacgggttaaaccttaaccggttaacccgttttaccttaacccgtaaccggttttcccggaccccgttacgggtaaccgttaaggtcggttacgaacgttaccgtaaccgaaacgggttaccttacggtcgtaccgttacggaaccctaccgttacgtttccttacggttaccttacg

SEQ ID NO: 167621 - DNA, 522 bp, Homo sapiens
  misc_feature: GYAE6OF02HJ43Q.16.81.H04.1.454.CMB.1.raw
  modified_base (334)..(334): a, c, t, g, unknown or other
  misc_feature (334)..(334): n is a, c, g, or t
  modified_base (502)..(502): a, c, t, g, unknown or other
  misc_feature (502)..(502): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaagcccctaagctcctgatctatgatgtctccaatataggaaagtggggtccatcgaaggttcagcggnagtggatcgtgggacagaattcactctacaccatcagcacgcctacacgcctagattgtatttgcgtactttattattcgaccaaactagttaataaagtagtttaacttctaacgtttccgcccgttagggacctaagtgtagattagtacaaacgtactggtacgntcgctacctatctgtcttac

SEQ ID NO: 167622 - DNA, 596 bp, Homo sapiens
  misc_feature: GYAE6OF02HWUKY.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgcatctgtcggagacagagtcacatcacttgccggcagtcagagtgttggtacctggttgcctggtatcagcagaaaccgagggaagcccctaagctcctgatctatgatgtctccaatataggaaagtcgggtaccagtacaaggttcagcggacaggtggatcgtagggactaggtaacttcaccttctaccgaaccactcacgcacgtacctacgagtcctagatcgtatttcgacgtactttattacttgacctaacgagttaataagtagtttacttacgtaaccgttttccggacccggttagggaacctaagttaggtacggttaacgttaactaacgtaaaacggtacttacgggtacggtacgttacggaccttaacccgtacgtttcccgttacggttcctttaacccg

SEQ ID NO: 167623 - DNA, 598 bp, Homo sapiens
  misc_feature: GYAE6OF02GS5FZ.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcaagaaaccagggaaacncccctaagcctcctgatctatgatcgtctacaatagtaggaaagtcgggtccagtcgaaggttcagcggcagtggatcgtgggacagtaatcactctcacatcagcacgcctacgacgtcctagtattgtattttcggaccgttaactttattacgttacgtaccctaaatagttaactaaaggtacgttttaacttaccgttaaccgttttccgggaccccgttaggggtaaaccctaaggttcggtacggtaacttaacgtaaccgtaaaacggtacgttaggttacggctacggacctaacctagttccgttggtacctttaccg

SEQ ID NO: 167624 - DNA, 508 bp, Homo sapiens
  misc_feature: GYAE6OF02FV48T.16.81.H04.1.454.CMB.1.raw
  modified_base (496)..(496): a, c, t, g, unknown or other
  misc_feature (496)..(496): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagcctcctgatctatgatgtctcaatatggaaagtggggtccagtcaaggttcagcggcagtggatcgtgggacagaattcactctcacatcagcacgcctacgagcctgatgtattttgacgtactttattacttgacctaatagttaataagtagttattactacgtttcgccgtggactatgtagatagtacaaacgtacgtgtagtctgacacctntcttgtcttacc

SEQ ID NO: 167625 - DNA, 514 bp, Homo sapiens
  misc_feature: GYAE6OF02G3SOZ.16.81.H04.1.454.CMB.1.raw
  modified_base (335)..(335): a, c, t, g, unknown or other
  misc_feature (335)..(335): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcagaaaccagggaaagcccctaagctcctgatctatgatgtctccaatatggaaagtggggtcccatcaaggttcagcggnagtggatcgtgggacagaattcactctcacatcagcagcctacagcctgatgtatttgacgtacttattattcgactaacagtataagtatttattacgtaactttcggacctagggaccaagttcgtaggtactactacgaaacgacgtagtaggctggacctaccgattctgttacc

SEQ ID NO: 167626 - DNA, 565 bp, Homo sapiens
  misc_feature: GYAE6OF02FXXGI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagccccctaagctcctgatctatgatgtctccaatatggaaagtggggtcccatacaaggttcagcggcagtggatcgtagggacagattcactctcaccatcagcagcctacacgcctgatgtattttggacgtactttagttattcgaccctaaagtagttaataaaggtagttttaattacgtaaccgttttcgggccccgttagggtaccctaaagttgtacggtaatacgttaaccaaacggttaacgtaggtacggtactcggtacctacccgattccgtgttcctttaccg

SEQ ID NO: 167627 - DNA, 509 bp, Homo sapiens
  misc_feature: GYAE6OF02FJFPV.16.81.H04.1.454.CMB.1.raw
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggcctggtatcagcagaaaccagggaaagcccctaagctcctgatctatgatgtctccaatatggaaagtgggtccatcaaggttcagcgcagtggatcgtgggacagaattcactctcaccatcagcagcctacagcctagattgtattttcgacgtactttattattcgacctaactagtaataagtagtttaattctaacgttttccggacccttgggacctagtgtagatagtacaacgtactgtgctgccacntctntcttac

SEQ ID NO: 167628 - DNA, 542 bp, Homo sapiens
  misc_feature: GYAE6OF02F6SSJ.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctaccaatataggaaaggtcggggtacccagtacaaggttcaggcggcgtagtggatcgtgggacagatcactctacacatcagcacgcctacacgcctgatgtatttgactactttattatcgtaccaagtagtagtaagtagtttacttacgtaacgtttccggacccgtagggaaccctaagtgttaggaatagtaccgaaacgtacgtggtaggtcgtagacctacctagtcttcgtcttac

SEQ ID NO: 167629 - DNA, 630 bp, Homo sapiens
  misc_feature: GYAE6OF02IAFON.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaaatgtgacatccagatgacccagtctccttccaccctgtctgcatctgtcggagacagagtcaccatcacttggccgggccagtcagtagtgttggtacctggttgcctggtatcagcagaaaccagggaaagcccctaagctcctgatctatgatgtctccaatataggaagtgggtccatcgaaggttcagtcggacgaggtaggatcgtgggaacaggtaaattcctacgttcctacgacctacttaccaagtcgaacgtcccgtaacacggtccctgaacgttgtaattttcgaccgttaacttttaagttactttacgaccaaactaaggttaacttaaaggtacgtttactttaaccgtaaccgtttttccggaccccgttagggaaaccctaacgttggtacgggtaactgtaaaccaaaccgggttaactggttacggacttaccggacctaaccgttaactttcgtaccgtttacgtttaacc

SEQ ID NO: 167630 - DNA, 498 bp, Homo sapiens
  misc_feature: GYAE6OF02FW1UA.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgctgggccagtcagagtgttggtacctggttggcctggtatcagcagaaaccagggaaacncccctaagctctgatctatgatgtctccaatataggaaagtcgggtccatcaaggttcagcggcaggtggatcgtgggacagaattcactctcacatcagcagcctacacgcctgatgtattttgcgtacttattattcgaccaactagtaataagtagttattactaactttcggaccctgggaaccagtgtagatatacaaacgtactgtgctgcctacatctgtc

SEQ ID NO: 167631 - DNA, 545 bp, Homo sapiens
  misc_feature: GYAE6OF02GJYXQ.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcacttggccgggcagtcagagtgttggtaccgtggttggcctggtatcagcaagaaaccgagggaaacgcccctaagctcctagatctatgatcgtctaccaagtagtaggaaacggtcggggtacccagtacgtaaggttcacggcggacaggtggatcgtagggacagtaacttcactctaccacctatcgacgcacgacctacacgcctagattgtatttcgacgtattattatacgtaccaatagttaatagtattattactaacgttccgccgtaggactagtgtagatagtacaaacgtactggttcgcgtcgactaaccattctcgtcttacc

SEQ ID NO: 167632 - DNA, 574 bp, Homo sapiens
  misc_feature: GYAE6OF02HTPZ2.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggccttggtatcagcaagaaaccgagggaaacgacccctaagctcctgatctatgatgtctcaatgtaggaagtgggccatcaggttcagcgcagtggatcgtggacagaattcactcacacatcagcacgtccacacgcctagtatgtatttgacgttactttatttatcgacctaaacgtagtaaagtaagttagtttaacttacctaacgttttcccggacccgtacggaaaccctaagttcggttacgaacttaacgtaacgtaaaaccggtacgttaggtacggtaccgtacgaccgtaacccgtacttaccgttcgttctttaacccg

SEQ ID NO: 167633 - DNA, 657 bp, Homo sapiens
  misc_feature: GYAE6OF02JD6Z5.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgcatctgtcggagacagagtcaccatcacttggccggccagtcagagtgttggtacctggttggcctggtatcgagcaagaaacgagggaacnccccgtaagctcctgatcgtatgatcgtctaccaattagtagggtaaaggttcgggtaccctagtacgtaaagggttcgaaggtcggacgtaggtggtaatcggtagggaacaagtaacttccgaacttccgtacctaaccgtagtaccgaacgtaccgaacgtaccctacgaacgtccgtaggtaacttggttaacttttcggaccgtttaactttaagtttacgttacgaacctaaacgtaagttaaataaggttaacgtttactttaccgtaaccgtttccggacccgttaaggaacctaagttgtacggtaatacgtaaccgtaaacgtacgtcggtacggtacgtacgtacctaaccgttacgtcgttacgttccgttaacg

SEQ ID NO: 167634 - DNA, 533 bp, Homo sapiens
  misc_feature: GYAE6OF02JC5PF.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatataggaaagtggggtcccatcaaggttcaggcggcagtggatcgtgggacagaattcactctcaccatcagcagcctacacgcctgatgtattttgacgtactttattattcgaccaacgtagttaataagtagtttacttacgtaacgttttcggcccgtagggaacctaagttggtagtatacgtacaaacgtaactcggtaggactgacctacctatccttgttcttac

SEQ ID NO: 167635 - DNA, 565 bp, Homo sapiens
  misc_feature: GYAE6OF02HRH5P.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcgccgggccagtcagagtgttggtacctggttgcctggtatcagcagaaaccagggaaagcccctaagctcctagatctatgatgtctacaatataggaaagtgggtcccatacgaaggttcagcggcagtggatcgtgggacagaattcactctacaccatcagacacgaccctacgacgcctagattagtattttgagttactttatttagttacgacctaaactaagttaattaacggtagtttaacgttactaaccgttttaccgggacccgttaggaacctaagtcgtaggtataactaacgtaaacgtaacgtgttacgcgtacgaccaccgtatcgttacgtacttacc

SEQ ID NO: 167636 - DNA, 620 bp, Homo sapiens
  misc_feature: GYAE6OF02JD3XW.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacgtcgccggcagtcagtagtgttggacctgggttgcctggtatcagcaagaaaccgaggaacgccctaagctcgtagactctatgactcgtactcaaatagtaggaagtcggggtaccatacgtaaggtcaggcggacgtaggtaggtactcggtaggaacgtaaggtaacttcgaactccgtacaacctataccgagtaccaacgtaccctaacgacgtaccgtagtaacgttaggttactttaccgaacggttaactttaagttacttaacgacctaaacggtaatagttaaattcggttaacttacttaaccggttcccgtacggttacggaactaaggttgtacggtaataacgtaaccggaaatcgtacgtggaccttacggactacctacggttctacgttacttacg

SEQ ID NO: 167637 - DNA, 520 bp, Homo sapiens
  misc_feature: GYAE6OF02HVV5T.16.81.H04.1.454.CMB.1.raw
  modified_base (439)..(439): a, c, t, g, unknown or other
  misc_feature (439)..(439): n is a, c, g, or t
  modified_base (495)..(495): a, c, t, g, unknown or other
  misc_feature (495)..(495): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaagcccctaagctcctgatctatgatgtctaccaatatggaaagtgggtcccatcaaggttcagcggcagtggatcgtgggacagtaatcactctacacatcagcagcctacagcctgatgtattttgacgtactttattattgcctaaactagtaataagtagttaacttnaaccgttttcggacccttaggacctaagttgtagatatacaaacgtaactgtacgntacgactacctatcttagtcttacg

SEQ ID NO: 167638 - DNA, 744 bp, Homo sapiens
  misc_feature: GYAE6OF02HU850.16.81.H04.1.454.CMB.1.raw
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtntcagcaagaaaccgagggaaacnccccgtaagcctccgtagacttcctaagtgtacgttcgtacctacctaaagttaagtaggggtaaaacgggttccggggtaccctaaacgttaccggttaaacgggtttaccgaacggtccggggtactaagggtttacggggaacgtttccgggtaacgggggaacctaaacgggtaaacttttacccaaaccgtttccgacctaaccgtacttacgaacgtacccgacgtaccctacgtaacggtcctaaggttacttacgggtaacttttacggaaccggttttaactttacgtttacgttacgaccgtaaacgtagttaacgtaagttactttaaacgtttccctaaacgtttccggtaaccgttacggaaacccttaagttggacgttaacttacgtaaccgaaaccggttagtttcggacgttacgtaccgtaccggtactacggtttacttcgttaccgtttac

SEQ ID NO: 167639 - DNA, 562 bp, Homo sapiens
  misc_feature: GYAE6OF02GGYB2.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgtcgggccagtcagagtgttggtacctggttggcctggtatcagcagaaaccagggaaacgcccctaagctctagatctatgatgtctaccaatataggaaaggtcgggtacccagtcgaaggttcaggcggacagtggagtcgtaggacagattcactcacacatcagcacgcctacacgtcctagatgtatttcgacgttactttagttacttacgacctaaactaggttaataaggtatttaacttacgttaaccgtttccggacccgttagggaacctaagttggtaggtaacttaactaaccaaacgtaactggtacggtactacgacctactattacgtgttacc

SEQ ID NO: 167640 - DNA, 785 bp, Homo sapiens
  misc_feature: GYAE6OF02FSXA2.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggcctcctgctgctcgtggcctcccgaggtatacaaatgtagactactccagatcgaccctagtccttcccttcccaccctgtctgctatcgtggtacggagacagacgtccacctatcctacgttcggcccgggaccagtacgagtagttggttcggtaccgttgggttcggtccgttggtatcgagtacaacgaaaccgaaggggaaaccgaccccgtaaagccttaccgtaggacttactagtagtacgttcgtcctaacctaaagttagtaacgggtaaaggttccggggtaccctaagttaccgtaaacgggttcaacgggaccggtacgtaagggtaggtacgttccggtaacgggggaactaaggtaactttacccgaaccgttaccgtacccgtaaacccgtataccgtaacggacctaaccgtcccgtaaacgtccggtaccgtaggtacgttagttacgttttacgaccgtttaacttttaagtttacctcgaaccttaaacgtaagtttaagttaaagttacgtttaacttaacccgtttaaccggttccggtaccccgggttaaggtaaccctaaggttacgggtaacggtaactttaaccgtaaccgaaaacggttacggtcggttacggaccgtacggaaccctaccgtagtttaccg

SEQ ID NO: 167641 - DNA, 554 bp, Homo sapiens
  misc_feature: GYAE6OF02F7MVF.16.81.H04.1.454.CMB.1.raw
  modified_base (277)..(277): a, c, t, g, unknown or other
  misc_feature (277)..(277): n is a, c, g, or t
  modified_base (346)..(346): a, c, t, g, unknown or other
  misc_feature (346)..(346): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacncccctaagcctcctgatctatgatgtctacaatagtaggaaagtcgggtccagtcgaaggttcagcggnagtggatcgtaggacagtaattcactctacactatcagcacgtcctacgacgcctgattgtattttcgacgtaactttattattcgaccctaaagtagttaactaagttagtttaactttactaaccgtttccggacccgttagggtacctaagtggtaggtataacgtacgaaacgtacgtggtacgtacgtgaccaccgtattccg

SEQ ID NO: 167642 - DNA, 515 bp, Homo sapiens
  misc_feature: GYAE6OF02GCLLP.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtccatcaaggttcagcggcaggtggatcgtgggacagtaattcactctacaccatcagcagcctacagcctgatgtattttggacgtactttattattcgacctaacagttaataagtagtttattactaactttccggcctgggaacctagtgtagtatagtacaaacgtactgtcgctgaccactatcgttcgtcttac

SEQ ID NO: 167643 - DNA, 517 bp, Homo sapiens
  misc_feature: GYAE6OF02HM9G9.16.81.H04.1.454.CMB.1.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcaagaaaccgagggaaacgcccctaagctcctgatctatgatgtctccaatagtaggaaagtgggtcccatcgaaggttcagcggacaggtggatcgtagggacagaatcactcncacatcancagtccacagcctgatgtatttgacgttatttattattcgacctaaactagttaataagtatttactacttaacgtttcgacccgttaggaacctagtgtagattacgtaacaacgtatgagctagcactatctcgttatcc

SEQ ID NO: 167644 - DNA, 494 bp, Homo sapiens
  misc_feature: GYAE6OF02FLA0V.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatatgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtactttattattgccaacagttataagagttattcaacttttcggcccttgggaccaagtgtggatatcaaacgaactgtgctgcaccatcttgtcttac

SEQ ID NO: 167645 - DNA, 556 bp, Homo sapiens
  misc_feature: GYAE6OF02GNG4J.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgacccctaagcctcctgatctatgatgtctacctaatagtaggaaaggtcggggtaccccagtacgaaggttcaacggtcggcgagtggtatcgtgggacagaatcactctacaccatcacgcgacgcctacacgctagattgtatttgacgtactttattacttacgacaactagtaataagtagtttaacttactaacgtttccgtaccgtacggaacaagtgtagtatacgtaacaaacgtacgtcgtacgtgtctaccgtaactacttctacgttcttaccg

SEQ ID NO: 167646 - DNA, 519 bp, Homo sapiens
  misc_feature: GYAE6OF02GT597.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcagaaaccagggaaagccctaagctcctgatctatgatgtctccaatataggaagtggggtcccagtcaaggttcagcggcagtggatcgtgggacaagattcactcacacatcagcagcctacagcctagatgtattttcgcgtacttattaattcgaccaaactagtaataagtatttattactaacctttcggccctgggacctaagtgtagatacgtactaaacgaacgttgtaggctggtaccacctatccttagttacc

SEQ ID NO: 167647 - DNA, 518 bp, Homo sapiens
  misc_feature: GYAE6OF02FJRTV.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtactttattattgacctaacagttaactaaagtagtttaatttctaacgttttccggacccttagggaaccctaatgtaggatagtacaaacgtaacgtgtggtctggcaccatcttgtcttac

SEQ ID NO: 167648 - DNA, 592 bp, Homo sapiens
  misc_feature: GYAE6OF02IDQH8.16.81.H04.1.454.CMB.1.raw
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcacttggcccgggcagtcagagtgttggtaccgtgggttcggcctggtatcagcaagaaaccgagggaacgccccgtaaagcctcctagatctatgatcgtctaccaagtatagggaagtcgggtacctagtacgtaaggttcagcggcgagtggagtcgtaggaacagtatcactctcacatcagcagacctaanacgcctnatgttatttagacgttaactttattagtacacgtaactaagttaagtaagttagttacttacgttaaccgtttccggacccgttaacgggtacctaaggttgacggttaataactacgaaacggtattacgggtacgtaccgtacgaccctaacggtacttccgttagttccttacgttacccg

SEQ ID NO: 167649 - DNA, 522 bp, Homo sapiens
  misc_feature: GYAE6OF02GNNQQ.16.81.H04.1.454.CMB.1.raw
  modified_base (420)..(420): a, c, t, g, unknown or other
  misc_feature (420)..(420): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatactggaaagtggggtcccatcgaaggttcagcggcagtggatctgggacagtaattcactctcaccatcagcagcctacagcctgatgtattttgacgtacttattacttgacctaaangtaagtaagtagttattactaactttcggacccgtaggtaacctagtagtaggatacgtacaaacgtactagtaggactgaccgtaccatcttagtcttacc

SEQ ID NO: 167650 - DNA, 744 bp, Homo sapiens
  misc_feature: GYAE6OF02IF74A.16.81.H04.1.454.CMB.1.raw
  modified_base (426)..(426): a, c, t, g, unknown or other
  misc_feature (426)..(426): n is a, c, g, or t
  modified_base (487)..(487): a, c, t, g, unknown or other
  misc_feature (487)..(487): n is a, c, g, or t
tcagtgtactactccacgaccggtgctcgatttagtagtgtagattcgcggggtcgaggactcagtcaggacacagcatggacatgagggtccccgcgtccagctcctggggctcctgctgctctggctccaggtatcaaatgtgacatccagatgacccagtctccttccaccctcgtctgcatctgtcggagacagagtcacctatcacttcgccgggtccaggtcagtagtgttgtaccgttggttcggtccttggtattcgagtcaagaaaccgaagggaaacgaccccgtaaagcctcccgtagacgttacctagtgagttcgtacctaccaatataacggaaaggttccggggtaccgaacgttcgtaaacggttacgacggcggtacgaacggtaggacgtttaccgtaggggtaacgnggtaaaacttcgaaccgttaccttacgacccttaataccaacgccaaccggtcctaaccgngtaccgtacgaacttacgtaagttttcgaaccgtttaccgtttaatttaacgttcgtaaccctaacgttaacggttaaacgttaaagttaagtttaacttttaacccgtaaacgtttttcccgacccggtttacggacccgttaaagttcgttacgggaactttaccgtaaacgtaaacccgtaaacgtttacgggtacgttaccggtacggtaccctaaccgttacctaacggtttccgtttacccggttttaccc

SEQ ID NO: 167651 - DNA, 533 bp, Homo sapiens
  misc_feature: GYAE6OF02FXXP6.16.81.H04.1.454.CMB.1.raw
  modified_base (191)..(191): a, c, t, g, unknown or other
  misc_feature (191)..(191): n is a, c, g, or t
  modified_base (391)..(391): a, c, t, g, unknown or other
  misc_feature (391)..(391): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccgggccagtcagagtgttggtacctgggttggcctggtactcgagcagaaaccagggaaacgcccctaagctcctgtatctatgatgtcgtaccaatagtaggaaagtcggggtaccagtacgaaggttcaggcggcgagtgatcgtaggacagtaatcactctcacatcagcagcctanacgctagatagtatttgacgttacttattacttcgacctaatacgttaataacgtagttattaccgtaacgtttcggaccttaggactaagtgtacgatacgtcgaaacgtactgtacgctagacacctatcgtagtcttac

SEQ ID NO: 167652 - DNA, 484 bp, Homo sapiens
  misc_feature: GYAE6OF02FKAW2.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggttcagcggcagtggatcgtggggacagaattcactctcacatcagcagcctacagcctgatgattttgctactttattattcgaccaatagtataagtgttattcaactttcgcctgggaccagtgtggatatacaacgactgtgctgcacatc

SEQ ID NO: 167653 - DNA, 578 bp, Homo sapiens
  misc_feature: GYAE6OF02HBUYY.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttgcctggtatcagcagaaaccagggaagcccctaagctcctgatctatgatgtctcctaatagtaggaaaggtcgggtccatcgaagttcagcggacagtggatcgtgggactagaattacactctacaccatccagcacgcctaacacgcctagactagtattttcggacgtaactttatttactcgtacctaaactagttaagtaagttagtttatttactaaccgtttacgtcccgtaggtaaccagttcggtaggtaataacgtacgtaaaaccgtacgttacggtacggtacgtacggtaccctaacgtacgtttacgttccgttctttaaccccg

SEQ ID NO: 167654 - DNA, 580 bp, Homo sapiens
  misc_feature: GYAE6OF02GZNZT.16.81.H04.1.454.CMB.1.raw
  modified_base (379)..(379): a, c, t, g, unknown or other
  misc_feature (379)..(379): n is a, c, g, or t
tcagtgtactactccacgaccggtgctcgatttagtagtgtagattcgcggggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccgtaagcctcctgatctatgatgtctcaatataggaagtcgggtccagtcgaagttcgagcgcaggtgatcgtaggacagtaattcactcctacacctatcgancacgcctacacgacctgattgtagtttcgacttactttattacttacgacctaagtagttaattaacgttaagtttaactttaccgtaaccgttttcccgggtacccgttacgggtaaccctaaggttcgttacggtaactacgttaaccgaaaacggttacgtaggttcggacgtcgaccgacctacgttcctacgttcc

SEQ ID NO: 167655 - DNA, 552 bp, Homo sapiens
  misc_feature: GYAE6OF02GG03Q.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcaagaaaccagggaaacgcccctaagcctcctgatctatgatgtctcaatataggaaagtgggtcccagtcaaggttcagcggcagtgatcgtaggacagtattcactctcacatcacgcacgcctacgacgtcctagtatagtattttacggcgttaacttttattagttcgtaccctaaagtagttaataaagttagtttaatttacctaacgttttccgaccgttaggaacctaagtcgtagatacgtacgaaacgtacgtggtagtcgtagaccaactcttcgttcgttcttaccg

SEQ ID NO: 167656 - DNA, 567 bp, Homo sapiens
  misc_feature: GYAE6OF02HS9BU.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggccttggtatcagcaagaaaccagggaaacgcccctaagctcctgatctatgatgtctaccaatagtaggaaacggttggggtccatacgtaaggttcaaggtcggcaggtggatacgtggggaacagtaacttccgactccgtacacctatcgaacgtcaacgcctaacagcctagacttagtatttcgacgtactttattattcgacctaacgagttaataagtagttacttcgtaacgttttcgacccgtaggaacctagttgtaggtataacgtacgaaacgtacgtgtaggcttcgacctaccgtatcgttgtaccttcg

SEQ ID NO: 167657 - DNA, 555 bp, Homo sapiens
  misc_feature: GYAE6OF02I5ROL.16.81.H04.1.454.CMB.1.raw
  modified_base (268)..(268): a, c, t, g, unknown or other
  misc_feature (268)..(268): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggtggcctggtatcagcaagaaccagggaaacnccctaagctacctgactctatcgatcgtctccaatagtaggaaacggtgggtacccaagtcgtaaggttcagcggactaggtggatcgagggacaggtaacttcacttcgacacgatcaagtccacgaccttacagtacctagtacgtgtactttcggacgttatttagttacgtacgactaacgtataacgtaagtgtttaactcttaacgttcgccgtaggtaactagttagagtatacgacgtaacgatggcgtctaggtaccacgtattcgtacttcgttacc

SEQ ID NO: 167658 - DNA, 564 bp, Homo sapiens
  misc_feature: GYAE6OF02HLVCD.16.81.H04.1.454.CMB.1.raw
  modified_base (269)..(269): a, c, t, g, unknown or other
  misc_feature (269)..(269): n is a, c, g, or t
  modified_base (351)..(351): a, c, t, g, unknown or other
  misc_feature (351)..(351): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaancccctaagcctctgatctatgatgtctccaatagtaggaaaggtgggtaccctatacgaaggttcaggcggcaggtgatcgnggacagtaattcactctacaccatcagcagccctagacgctgactgtatttgacgttattattacttgacctaactaagtaattaaacgtagtttactttaccgtaaccgttttcccgggacccgttagggtaaccctaagttggtaggtaattaacgttaaccaaaacggtactaggttcggactcgaccaccgtattcttacgtccttacg

SEQ ID NO: 167659 - DNA, 651 bp, Homo sapiens
  misc_feature: GYAE6OF02IKTH5.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgctggtatcagcaagaaaccgaagggaaacgcccctaagcctccgtgactactatgtatcgtactactaatagtagggaaagttcgggtcccaagtcgtaaggtcgagcggacaggtggacttcggtagggaactaaggtaaactttccaaccttcctaccaaccctagtaccagtaccaacgtacctacgaacgtccgtagtattagtattttcggacctttacgtttaatttacgttacgacctaaagtaagttaagttaagtagttttaacttaccgttaaccgtttaccgggtacccgtacgggtaaccctaagttggtacgtaacgttaacgtaaccgtaaaaccgtacgttaggtaccgtacgttccggaacctaccgttacttaccggttcgttaccttacccg

SEQ ID NO: 167660 - DNA, 707 bp, Homo sapiens
  misc_feature: GYAE6OF02IPSJR.16.81.H04.1.454.CMB.1.raw
tcagtgtactactccacgaccggtgctcgatttagtagtgtagattcgcgggggtcgagactcagtcaggacacagcatggacatgagggtccccgctcagctcctggggctcctgctgctctggctcccaggtatcaaatgtgacatccagatgacccagtctccttccaccctgtctgcatctgtcggagacagatcaccatcacttgccggccagtccagagttgttggtacctgggttcggtcctggtactcagacaagaaaccgagggaaacgaccccgtaaagccgtacctaggactctactgatcgtctaccgtaatagtacggaaagtcggggtacctagtacgaaggttcgagtcggtacaggtgtagtacgtagggactaaggtaattcgaccgttactaccgtaacctatacgtacgacgtacgtacccgtaactacggtcctaggtaactcgttagttttcgacgttaacgttttaacttacgttacgacctaaaccggtagttaaagttaaaacggttagtttaaccgttttaccgtaaacgttttcccgggtaacccgtttacgggaaaccccttaaggttcggtacggttaagttaccgtaaaacggtaaaccggttaccgttaagggttacggtaccggttaacgtaccggtaacccttaggtttaccgttaccggtttccctttaaccgg

SEQ ID NO: 167661 - DNA, 549 bp, Homo sapiens
  misc_feature: GYAE6OF02HWSZU.16.81.H04.1.454.CMB.1.raw
  modified_base (333)..(333): a, c, t, g, unknown or other
  misc_feature (333)..(333): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaacgcccctaagctcctgatctatgatgtctccaatagtggaaagtgggtccatcaaggttcagcggnagtgatcgtggacagaattcactctcaccatcagcacgcctacagcctgatgtattttgcgtactttattattcgacctaaacgtagtaataaagtacgtttaacttacgtaacgttttccggacccgtagggaaccctaagtcggtagacttaacgtaccgtaaacgtaacttggtacggtctacgaccgaccctaagttcgttacgttcttacg

SEQ ID NO: 167662 - DNA, 657 bp, Homo sapiens
  misc_feature: GYAE6OF02JABX2.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggacctggttgcctggtatcagcaagaaaccagggaacgcccctaagctcctagatctatgatgtactacctaatagtaggaaacggttgggtaccctaagtaccgtaaaggttccgaaggtccggacgtaggtcggtaacttcgtaggggactaaggtaactttccgactaccgtacaaccgtatacgagacctacggacccttacgacgtactacggtaattacggttaactttcggacgtttaactttaagttacgttacggtaccaaaaccttagtaaacgttaaaggtaccgttttaagttacccttaacgtttccggaccgtttaacgggaactaagttggtacggtaattaacgaaccgtaaacgtaacgttggtacggtacgtacggaccctaacgttacgtaccgttacgttaccttaccg

SEQ ID NO: 167663 - DNA, 525 bp, Homo sapiens
  misc_feature: GYAE6OF02GPUDU.16.81.H04.1.454.CMB.1.raw
  modified_base (339)..(339): a, c, t, g, unknown or other
  misc_feature (339)..(339): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttgcctggtatcagcagaaaccagggaaagcccctaagctcgtgatctatgatgtctccaatataggaagtcgggtccagtcgaaggttcagcgganagtggatcgtgggacagtaattcactctcaccatacagcacgcctacgngcctgatgtatttgacttattattactnaccaatagtagtaatagtttattactaacttcggacctgggacctagtggtaggtaattacgtacgtaaacgtaccgttaggttcggactacgtacctacctattaccg

SEQ ID NO: 167664 - DNA, 559 bp, Homo sapiens
  misc_feature: GYAE6OF02H7C1J.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaacgcccctaagctcctgactctatgatgtctacaatagtaggaagtcgggtcccagtcgaaggttcagcggcaggtgatcgtaggacagtaattcactcacacatcagcacgtcctacagtcctgacttgtagttttgacgttactttaattacttacgaccaaacgtagttaataaaggtatttaacttaccttaaccgttttccgacccgttaggaaccctaagttcgtagaacttacgtaactaaacgtacgtagtacggtactcgacaccgtactcgttagtccttac

SEQ ID NO: 167665 - DNA, 634 bp, Homo sapiens
  misc_feature: GYAE6OF02JNX32.16.81.H04.1.454.CMB.1.raw
  modified_base (206)..(206): a, c, t, g, unknown or other
  misc_feature (206)..(206): n is a, c, g, or t
  modified_base (584)..(584): a, c, t, g, unknown or other
  misc_feature (584)..(584): n is a, c, g, or t
tcagtgtactactccacgaccggtgctcgatttagtagtgtagattcgcgggggcagggagtcagactcagtcaggacacagcatggacatgagggtccccgctccagctcctggggcctcctgcctgctctggctcccaggtatcaaatgtgacatccagatcgacccagtcctcccttccaccctgtctgcatcgtgtacgganacagacgtcaccatcactcggccgggccagtccaggagtgttcgtacctggttgctggtatcagcagaaccgaggaacgacccgtaagctccgtgtactactatacgatcgtctacgaactagtaggaaacggttcggggtacctacgtacgtaacggttaccgaggcggtacgtaggttacggagtacgtacgggtacaaggtacgttctaacttcgtactacctactacgacgaccacgacctacgtcggtaccctagtacttacgttagtttacggtactaactttattacgttacgtaacctaagttacgtaagttaaagttactttacgttaccgtaaaccgtttcggtaccctacgggtacctatcgggtanaacgtttacaaccgtaagacgttggtacggccttacggactcgattaccg

SEQ ID NO: 167666 - DNA, 528 bp, Homo sapiens
  misc_feature: GYAE6OF02IJXEA.16.81.H04.1.454.CMB.1.raw
  modified_base (271)..(271): a, c, t, g, unknown or other
  misc_feature (271)..(271): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctgggttggcctggtatcagcagaaaccagggaaacncccctaagctcctgatctatgatgtctccaatataggtaaagtcgggtccatcgaaggttcagcggcagtggatcgtggacagtatcacttcacaccatcagcacgcctacagcctgatgtattttgccgttaatttacttattaaccaatagtaataagtatttatacgtacttccggcctagggtaaccagttgtagtatataacgaacgtacttggtagcgtagccgtactattcctagtcttccgtattcccg

SEQ ID NO: 167667 - DNA, 682 bp, Homo sapiens
  misc_feature: GYAE6OF02J2VL1.16.81.H04.1.454.CMB.1.raw
  modified_base (272)..(272): a, c, t, g, unknown or other
  misc_feature (272)..(272): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcggccgggcagtcagagtgttggtacctggttcggcctggtatcagcagaaaccgagggaacncccctaagcctcctgactctaatgatcgtactaccaagtacgtacgggtaaacggtcgggtacccctaagtaccgtaaacgggttccaacggccgggtctaacgggttcggtaaacgtcggttacggggaacctaagggttaacctttaccaacgtttcccgaacctaaccgtacgtacgacgccgtaacgaccctacgacgtcctaggtacttagtacgtttacgacgtaactttattacgttcgacctaagtaagttaacgtaagttacgtttaacttacgttaaccggttttccggacccttacgggaactaacgttgggtactaacgttactaaaccgtaaacggtacgttacggtacggtaccgttcggaacctaccgttaagttcgtttaccgttctttacccg

SEQ ID NO: 167668 - DNA, 576 bp, Homo sapiens
  misc_feature: GYAE6OF02F839O.16.81.H04.1.454.CMB.1.raw
  modified_base (367)..(367): a, c, t, g, unknown or other
  misc_feature (367)..(367): n is a, c, g, or t
tcagtgtactactccacgaccggtgctcgatttagtagtgtagattcgcgggggagtcagactcagtcaggacacagcagtgggacatgagggtccccgctcagctcctggggctcctgctgctctggctcccaggtatcaaatgtgacatccagatgacccagtctccgttccaccctgtctgcatctgtcggagacagagtcaccatcacttgccggcagtcagagtgttggtacctggttggcctggtatcagcaagaaaccagggaaagcccctaagctcctgatctatgatgtctcaatataggaagtgggtccatcgtaagttcagcgcagtggatcgtggacagtatcacgtctacaccntacagtcgacgacctacgacgtcctagtatgttatttcgacgttacttattattcgacccaaagtagtaagttaagtagtttaattaccgttaaacgttttccggacccgttagggaaccctaaggttgttaggtaacgttaacgtaaccgtaaacggtaaccgtggttacggtcttacggacctaaccgtacttaccgttagttaccc

SEQ ID NO: 167669 - DNA, 562 bp, Homo sapiens
  misc_feature: GYAE6OF02FJKP0.16.81.H04.1.454.CMB.1.raw
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (435)..(435): a, c, t, g, unknown or other
  misc_feature (435)..(435): n is a, c, g, or t
tcagtgtactactccacgaccggtgctcgatttagtagtgtagattcgcggggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcagaaaccagggaaacgcccctaagcctccgtgactctatgatcgtctaccaatagtaggaaaggtcggggtacccatacgaaggttcagcggnagtggatcgtggacanattcactctcaccatcagcacgtaccctacgacgcctagatagttagtttgacgttaactttagttactntacctaaactagtaataaggtatttagttactaaccgtttccggacccgttggaaccgattggaggtacttaactaacgtaaacgaacttaggtacggtctcgacctacctagttccgtgttacccg

SEQ ID NO: 167670 - DNA, 607 bp, Homo sapiens
  misc_feature: GYAE6OF02GZQ90.16.81.H04.1.454.CMB.1.raw
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcggccgggccagtcagtagtgttcggtacctgggttggccttggtatcgagcaagaaaccgagggaaacgcccctaagctccgtagatctatgatgtctactaatagtagggaaacggtcgggtacccagtacgtaaggttcaggcgagtaggtaggtntgaggacaagtaacttcactctaccactancacgtcaacgtcctacgacgtctagattagttagtttgactttactttattactacgaacctaagtagttaaagttaagttagtttaactttaaccgtaacgtttacccggaccgttacggaacttaaggtggtagtaacgttaagtaaccgaacggttaacgtggttacggtactacgtacgtacccttagttccgtgttaccttacg

SEQ ID NO: 167671 - DNA, 554 bp, Homo sapiens
  misc_feature: GYAE6OF02G76UI.16.81.H04.1.454.CMB.1.raw
  modified_base (197)..(197): a, c, t, g, unknown or other
  misc_feature (197)..(197): n is a, c, g, or t
  modified_base (341)..(341): a, c, t, g, unknown or other
  misc_feature (341)..(341): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccggcagtcagagtgttggtacctggttggcctggtatcagcagaaaccaggggaaacgcccctaagctcctgatctatgatgtctaccaatataggaagtcgggtccatacaaggttcagcggnaggtggatcgtggacagattcactcacaccatcagcacgtccacgnccgtnagttgttatttacggaccgttactttaatttacgttacgacctaaacgtaggttaaactaagttacgtttaacttaccgtaaccgtttccggaccgtaggtacctaagttggtacgtaatacgtacgtaaaccgtagttcggtatccgtacnctaccnttcg

SEQ ID NO: 167672 - DNA, 569 bp, Homo sapiens
  misc_feature: GYAE6OF02HSP5Q.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggccttggtatcagcaagaaaccagggaaacgcccctaagctcctgatctatgatgtctccaatatggaaagtgggtaccagtcaaggtcagcggcaggtgatcgtggacagattcactctacaccatcagcacgcctacacgacctgatcggtattttcggacttacttagtttactcgacctaatagtaactaagtagtttacttcgttaaccgttccgtcccgtaggaaccctagtcggtagtacgttaacgtacctaaaacggtaacttagggtacgtacttacggtaccgaacccgtatttaccgttacggttcctttaacccg

SEQ ID NO: 167673 - DNA, 582 bp, Homo sapiens
  misc_feature: GYAE6OF02IMT05.16.81.H04.1.454.CMB.1.raw
  modified_base (407)..(407): a, c, t, g, unknown or other
  misc_feature (407)..(407): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttgcctggtatcagcaagaaccagggaacaccctaagctcctagtatctagtgatgtctaccaatagtaggaaacggtcgggtacccagtacgtaaggttcacggcggacgtaggtacggatcgtgggaactagtaacttcactccacaccatacgagacacgcctaacgngtcctagtagtgttagtttcgacgtacttatttctgaccaacgtaagtacttaagtagttaattccgtaacgtttccgaccgttacgggaaccttagtgttacggaacttacgtaaccgtaaacgtcgttacggtacgtaccgtacgaccgtacctagttcttacgtcctttacg

SEQ ID NO: 167674 - DNA, 521 bp, Homo sapiens
  misc_feature: GYAE6OF02H50U8.16.81.H04.1.454.CMB.1.raw
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (369)..(369): a, c, t, g, unknown or other
  misc_feature (369)..(369): n is a, c, g, or t
tcagtgtactactccacgaccggtgctcgatttagtagtgtagattcgcgggggtcagactcagtcaggacacagcatggacatgaggggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttggcctggtatcagcagaaaccagggaaacgcccaagctcctgatctatgatgtctcaatanggaaagtgggtccatcaagtcagcggnagngntcngggacagaatcactctacacatcagcagcctanacgctagtatgtatttcgacgtactttattatgaccaactagtaataacgtagttattacgtaactttccggaccctagggaacctaagtgtacggtaataacgtactaaaccgaacttggtcggaccttgacaccgattccttgtcttacg

SEQ ID NO: 167675 - DNA, 828 bp, Homo sapiens
  misc_feature: GYAE6OF02HVX52.16.81.H04.1.454.CMB.1.raw
  modified_base (192)..(192): a, c, t, g, unknown or other
  misc_feature (192)..(192): n is a, c, g, or t
  modified_base (430)..(430): a, c, t, g, unknown or other
  misc_feature (430)..(430): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgaccagttcctccttccacctgtctgcatctgtcgganacagagtcacatcacgttcgaccggcagtcagagttggttaggtaccgttggttcggcctggtatcgagcaagaaaccgagggaacacccctaagcctcctagactctatcgatcgtctaccaagtagtacggaaggtcgggtacctaagtacgtaacggttcaggtcggtcgaggtggtacttcggaacgggtaacaggtaacttccgaactttcctaccaaccgtacgtaccgtanacccgtaacgtaacccctaacgtaaccggtcttacgggttaacgttacggtttacgtttttaaccgggtaaccggttttaaaccttttttaaacgttaacggttttcccgtaaaaccgtaaaaaccgtttaaacgggttttaaacggtttaaaaaccgtttaacgggtttttttaaacctttaaccgtttaaacccccggttttttaaccccggggttacccccggtttaaacgggggtaaaacccccttttaaggggtttaacgtaaccggggtttaacctttaaaccgttaaacccggttaaaaccggttaacgttacgggtttaccggtaccggttacccgtacccgaaaaccgttttcgttaaacccgttccggttttaaccccgtttaacccg

SEQ ID NO: 167676 - DNA, 665 bp, Homo sapiens
  misc_feature: GYAE6OF02IC2CS.16.81.H04.1.454.CMB.1.raw
  modified_base (445)..(445): a, c, t, g, unknown or other
  misc_feature (445)..(445): n is a, c, g, or t
  modified_base (637)..(637): a, c, t, g, unknown or other
  misc_feature (637)..(637): n is a, c, g, or t
tcagtgtactactccacgaccggtgctcgatttagtagtgtagattcgcgggggtcgatactcagtcaggacacagcatggacatgagggtccccgctcagctcctggggctcctgctgctctggctcccaggtatcaaatgtgacatccagatgacccagtcctccttccaccctgtctgcatctgtacggagacagagtcaaccatctacttcggccgggccaggtcaggagttgttggtacctgggttcggccgtggtatcagtcgaagaaaccgaagggaaacgaccccctaagcctacctacgactactatacggtatcgtcctaccaatacgtagggaaacggttcggggtacccagtacgtaacggttacacggaccggctagggtacgtacgtcggtaagggaactagtaacttccgaacctacctaccgaacctanacctagacctacggtaccctacacggtaccgtagtaacgttcggtaagtttcggtaaccgtttaacgtttaatttacggttaccaacgtaaaccgtaagttaacgtaaagttacgttacttaacgttaccgtttaccggcccgtaggaaccctaagtcgtaggtattaacgaacgaaacgtcgtaggttcgngtcgaccacctagtcttagttcttaccg

SEQ ID NO: 167677 - DNA, 696 bp, Homo sapiens
  misc_feature: GYAE6OF02IZ8S7.16.81.H04.1.454.CMB.1.raw
  modified_base (427)..(427): a, c, t, g, unknown or other
  misc_feature (427)..(427): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
tcagtgtactactccacgaccggtgctcgatttagtagtgtagattcgcgggggtcgagactcagtcaggacacagcatggacatgagggtccccgctcagctcctggggctcctgctgctctggctcccaggtatcaaatgtgacatccagatcgacccagtctccttccaccctgtctgcatctgtccggagacagacgtcacctatcctacgttcggcccgggaccacgtccgaaggtagttcggtttcgggtaacccttggggttcggacccgttggtaactccgagtacgaaacggaaaaccgtaggggaaaacctccccgtaaaggccctacccgtaggtaacttccgtaagtcgtaacgttcgtacctacctaagtacgtagggtaacggtcgggtacccataccgtaggttcacggcgngaggtgacgttcgaggacagtaatccgactctacacgtntacngacacgcctagactcctagttactgttactttcgacgttaacctttagtttacgtacctaaccgtaagtaacgttaaagttaacgttagtttaaccgtttaacgtaacccggtttccggaccccgtaggtaaccctaggttcgtacggtacttaacggtaacgtaaacggttaccgtggtaccgtcgttaccggtactaacctggttacctacggtttctaacccg

SEQ ID NO: 167678 - DNA, 566 bp, Homo sapiens
  misc_feature: GYAE6OF02IO4GZ.16.81.H04.1.454.CMB.1.raw
  modified_base (269)..(269): a, c, t, g, unknown or other
  misc_feature (269)..(269): n is a, c, g, or t
  modified_base (332)..(332): a, c, t, g, unknown or other
  misc_feature (332)..(332): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcgagacagagtcaccatcacttgccgggccagtcagagtgttggtacctggttggcctggtatcagcagaaaccagggaaacncccctaagctcctgatctatgatgtctccaatatggaaagtcgggtccatcaaggttcagcgnagtgatctggacagatcactcacacatcagcagcctacacgtcctgatgtattttcgacgttactttattacttgaccctaatagtaataagtagtttactttacctaacgttttccggacccgttacgggaaccctaaagttcggtaggtacttaagtaccgtaaaaccggtaaccgttgggttacggccgttagtacccgaaccgtattccgttagtttcccttactacccg

SEQ ID NO: 167679 - DNA, 806 bp, Homo sapiens
  misc_feature: GYAE6OF02HCFD9.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtcctgcatctgtcggagacagagtcaccatcacttgccgggccagtcagagtgttggtacctggttggcctggtatcagcagaaaccagggaaacgcccctaaagctcctgatctatgatgtctaccaattagtagggaaacgttcgggggtccctaagtacgtaaagggtttccaaggtccggacgtaaggtcggtaacttccggtaggggaacctaaggtaaacttcgaaaccttcctacctaaccctaacttaccaaggaccctaacggaccccttaaaccgtaaccgggaccccttaggaacgtttaggttaaccgtttttttagggacccggtttaaacctttttaaacgttttaacgtttaccggtaaccccgtaaaacgtaaaccggtttaaaggttaaaagggtaaacggttttttaaacctttaacccgtttaaaccggtttttaccccgggtacccccggtttaacgggggttaaaacccctaaagtttacggggttaaccgggtaattaacgttaaacccggtaaaaacccggtaaacgtttacggggtaccgggttaccgttaaggtaaccctaaccggtaactttaccggttacggtttaccctttaaccttaacccg

SEQ ID NO: 167680 - DNA, 678 bp, Homo sapiens
  misc_feature: GYAE6OF02I8UEY.16.81.H04.1.454.CMB.1.raw
  modified_base (286)..(286): a, c, t, g, unknown or other
  misc_feature (286)..(286): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttcggcctggtatcagcaagaaaccgagggaaacgccctaagctcctanatactatgatcgtctaccgaatacgtagggaaacggttcgggtacccagttacgaaacggtttcgaggcggtacgaaggtcggtaactcgtaggggacctaaggtaactttaccacgttcctaccaacgtactaccgaacgtccgaacgcccttaacgacggtcctaggtacttacgtagtttttcgacccgtttatttaacgtttaacttacgaacctaaattaacggttaattaaagggtttactttaagtttaccctaaaccggtttttcccgacccggttacggtaaaccgtaagtttacggtaggttaaacttacgtaaaccgttaaaccggtaagtacggtaccggtacttaccgaccgtaccttagttccttcgtacctttaccg

SEQ ID NO: 167681 - DNA, 694 bp, Homo sapiens
  misc_feature: GYAE6OF02I35OC.16.81.H04.1.454.CMB.1.raw
  modified_base (267)..(267): a, c, t, g, unknown or other
  misc_feature (267)..(267): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttcggtacctggttgcctggtatcagcagaaacagggaacnccctaagctcctagactctaatgatcgtctaccaaagtatagggaaacgttcggggtccctaagtacctaaggttcacggcggtcaaggtcggaattcgtagggaacaagtaacttcaacgttcctaccgaaacctactaccgaagtaccgaccgtaccttaaacgaccgtccttagaactagttacttttcggacgttactttaagtttagtaccgtaccaaacgtaagttaacgttaaaggttacgtttaaactttacccgtaaaccgtttttaccgggacccccggtttagggtaaaacccctaggtttaacgggttacgtaacttaacgttaacccggaaaaaacggtaccgtttagggtaccggtccgttacggaccccgtaaaccttaaggttccccgttttacggtttcccttaacccgg

SEQ ID NO: 167682 - DNA, 582 bp, Homo sapiens
  misc_feature: GYAE6OF02G1P6V.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgcccgggccagtcagagtgttggtacctggttggcctggtatcaacagaaaccagggaaacgcccctaagctcctgatctatgatgtctccaatagtggaaagtgggtccatcaaggttcagcggcagtggatcgtggacagaattcactctcacatcagcagcctacagcctgatgtatttgactactttattacttgacctaactaagttaataaaggtagttttaacttaccgttaacgttttccgggacccgttacggggaaccctaagttcggtacggtaataacgttaaccgaaaaccggttaacttgggttacgggtacctacggtacctaacccgtagttccgtttacggttaccctttaccg

SEQ ID NO: 167683 - DNA, 811 bp, Homo sapiens
  misc_feature: GYAE6OF02FGNGU.16.81.H04.1.454.CMB.1.raw
  modified_base (410)..(410): a, c, t, g, unknown or other
  misc_feature (410)..(410): n is a, c, g, or t
  modified_base (561)..(561): a, c, t, g, unknown or other
  misc_feature (561)..(561): n is a, c, g, or t
  modified_base (741)..(741): a, c, t, g, unknown or other
  misc_feature (741)..(741): n is a, c, g, or t
tcagtgtactactccacgaccggtgctcgatttagtagtgtagattcgcgggggtcagactcagtcaggacacagcatggacagtcggacggtccccgctcagcctccgtcggggtcctccgtgtccttcgcctccgtccggaccttacccgaggttacacctaagtcgtacaactacctaccgaacgtaccgtacccgtaacccttaccgttccccttaccctacccctaccgtcgtcgtaccgtacgtacgtcggtaccggacgaccgtacgaccgtacctacctacgtccgtaccggttccgccggtaccgtcgtacgcggttacggtttcggttaccgttccggttcggtacgtacgtacgacacgacggaacgaccgaaccggtaaccgaaccgtcctacgtccncgtaactcgttaactgtacgtatacgtaacgtaaccgtaggttaccggtacgtaccggtacgtacgacggttaacggtacgcggtaacgtccggtaagtccggtagacccgtaagtaaccttacgtacctaccgtttaccaaccccggtanacccggtaactaccgggacctaaccgctaaccgtctacgtactacggttactacttaaccgttgtaacttaccttaactaaccttaacgaaccgttaacgttacgtaaactttaaccggttacttaaccgttacccgtaaccggtttcgaaccgtagactaagacggtacaaccgttacnccgtaacgtcgtacgacctttacgcctacgtacgttccgtaacccttcggtaacccgttctctaacccgg

SEQ ID NO: 167684 - DNA, 561 bp, Homo sapiens
  misc_feature: GYAE6OF02G7M8U.16.81.H04.1.454.CMB.1.raw
  modified_base (273)..(273): a, c, t, g, unknown or other
  misc_feature (273)..(273): n is a, c, g, or t
  modified_base (347)..(347): a, c, t, g, unknown or other
  misc_feature (347)..(347): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccggccagtcagagtgttggtacctggttggcctggtatcagcaagaaaccaagggaaacncccctaagctcctgatctatgatgtactcaatagtaggaagtgggtcccatcgaaggttcagcgcagtgatcgngggacagattcactctcacatcagcacgacctacgacgtcctgattgtactttcggacgttatttattatcgtaaccaacgtagttaagtagtaagtttacttacctaaccgttttccggacccgtaggtaacctagttcggtagtacttaacgttacgaaacgttagtcggtcggtactcggtacctacctagttccttacgttacctttacc

SEQ ID NO: 167685 - DNA, 570 bp, Homo sapiens
  misc_feature: GYAE6OF02GGK3T.16.81.H04.1.454.CMB.1.raw
  modified_base (268)..(268): a, c, t, g, unknown or other
  misc_feature (268)..(268): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccggccagtcagtagtgttggtacctggttgcctggtatcgagcagaaaccgaggaacncccctaagcctcctgactctatgtatcgtctaccaatagtaggaaaggttcgggtaccatacgaagttcgagcggagaggtggactcgtaggaacagtaatcactctacaccatcgagctacgcctacgacgtctgattgtatttgtacgttaatttattacttacgacctaagtaataagttaagtagtttacttacgtaacgttccgaccgtaggaactagtgtagtactaacgtaaccgtaaacgtagtggtacgtctacggaccctacgttacttccgttacgttaccgttctacccg

SEQ ID NO: 167686 - DNA, 566 bp, Homo sapiens
  misc_feature: GYAE6OF02FLDNY.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagccccaagctcctgatctatgatgtctccaatatggaaagtggggtacccatcgaaggttcaggcggacagtcggatcgtgggacagtaattcactctcacatacagcagccctacacgtccgtagatgtattttggacgtaactttaatttacttcggaaccctaaacgtagttaataaagtacgttttaacttaccgtaaaccttttccgggacccttacgggaacctaagttgttacggaatacgtaacgaaacgtaacgtaggtagactggacctaccattcctagttcttacg

SEQ ID NO: 167687 - DNA, 537 bp, Homo sapiens
  misc_feature: GYAE6OF02IY8IQ.16.81.H04.1.454.CMB.1.raw
  modified_base (348)..(348): a, c, t, g, unknown or other
  misc_feature (348)..(348): n is a, c, g, or t
  modified_base (393)..(393): a, c, t, g, unknown or other
  misc_feature (393)..(393): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgttggtacctggtggcctggtatcagcagaaaccgagggaaacgcccctaagctacctgatctatgatgtctccaatagtaggaaacggtgggtccatcgaaggttcaggcgcgagtggatgngggacagattcactctcacatcagccagaccctacgacgtcgtanatgtatttggacgtatttatttactcgtacctaatagtaataagttagtttaattaccttaacgtttccgacccgttggaacctagtgtagtattaacaactaaacgactagtcgtcgtacgacactacgtcttcgtacttccg

SEQ ID NO: 167688 - DNA, 709 bp, Homo sapiens
  misc_feature: GYAE6OF02I788G.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgcccgggcagtcagagtgttggtacctggttggcctggtatcagcagaaaaccagggaaacgcccctaagctcctgatctatgatgtctaccaaatatagggaaaacgtgggggtacccaagtacgaaaggtttcgaggtcggacgaggtacgggattcgagggtacgtaaggaacttccgaccttactacaaccaacttaccaaggtccaacgtacccgtaaacgcgtacccgttgaagttggtaactttttcggaccggttaacttttaagtttagttaccgtacctaaaactaggttaaacgttaaacgttaagtttaattttaacccgttaaacgtttttacccgggtaccccgttagggggtaaaccctaaaaggttaccgtttagggtaacttaacgttaaacccgtaaaaacggttaaaccgttacggttaacgggtaccgtttaaccggaccgtaaccgtaacttccgtttacgtttaccttaccttaacccg

SEQ ID NO: 167689 - DNA, 553 bp, Homo sapiens
  misc_feature: GYAE6OF02HD51C.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggaggcagagtcaccatcacttgccgggccagtcagagtgttggtacctggttggcctggtatcagcagaaaccagggaaagcccctaagctcctgatctatgatgtctccaatatggaaagtgggtacccatcgaaggttcagcggcagtggatcgtgggacagaattcactctcaccatcagcagcctacagcctgatgtattttgacgttacttattatgacctaaacgagttaattaagtaagtttacttacgtaaaccgttttcggacccgttagggaacctaagtcggtagtactaacgtacaaaacggtaacgttggttaggtacttacggacctaacccgtactcgttagttaccc

SEQ ID NO: 167690 - DNA, 686 bp, Homo sapiens
  misc_feature: GYAE6OF02JZ17F.16.81.H04.1.454.CMB.1.raw
  modified_base (191)..(191): a, c, t, g, unknown or other
  misc_feature (191)..(191): n is a, c, g, or t
  modified_base (267)..(267): a, c, t, g, unknown or other
  misc_feature (267)..(267): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccgggccagtcagagtgttggtacctgggttgcctggtatcagcagaacagggaacncccgtagctcctagatctatgatgtctacaagtataggtaaagtcgggtacccagtacgtaacggttcgacggcggcgaacggtggacgtacgttacggggaacaggttaacgtaccgtacgttacccgtaccaaccgttaacgtaccgaacgaccgtaacggccgttaaaccgacgtcccgttacgagttacgttactttttacggaccgtttaactttaagtttacgttacgtaccgtaaaccttaggttaattaaacggttacgtttagtttaacccgttaacccgtttacccgggtaccgttacgggaaaccttagggttagttacgtaacttacgttaaccgtaaacggtacttagggtaaccggtccgttaaggacccgaacgttcgtacggtttacgttccttaccgttccc

SEQ ID NO: 167691 - DNA, 677 bp, Homo sapiens
  misc_feature: GYAE6OF02I3NJ4.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtggttggtacctggttggccgtaggtatcgagtcgaagaaaccgtaagggaaacgacccgtaagcctacgtgatacgtatagatcgtactccaagtagtagggaaaggttcggggtaccctagtaccgtaaagggttccaaggcggtacgtaggtcggagtacgtagggaactaagtaacgttacacgttccgtacacctataccgagaccgaacgtccctaacgtacgacctagaacttgggttacttttcggaccgtttaaacttagttttacttccggtaaacctaagtaacgttaaattaaaggtttaacgtttaacgtttaacgttaaacccgttttcccggggtaccgttaaccgggtaataaaccgttggtaacgtagttaacctaagtaaacgttaccgtggtacgacgttagaccttacgatttccgtaggttccttataccg

SEQ ID NO: 167692 - DNA, 629 bp, Homo sapiens
  misc_feature: GYAE6OF02H9X5J.16.81.H04.1.454.CMB.1.raw
  modified_base (191)..(191): a, c, t, g, unknown or other
  misc_feature (191)..(191): n is a, c, g, or t
  modified_base (269)..(269): a, c, t, g, unknown or other
  misc_feature (269)..(269): n is a, c, g, or t
  modified_base (343)..(343): a, c, t, g, unknown or other
  misc_feature (343)..(343): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttcgccggcagtcagagttgttggtacctggttgcctggtatcagcaagaaaccagggaacnccctaagctcctagattctaatgatcgtactcaatagtaggaaaggtcgggtaccagtacgaaggttcagcggnagtgatcgaggacagtaacttcgactacgtccaactatacagtacaacgtcctaacgacgtcctagtaatcgttacgtttacgacgtttaacttttagttaacgttcggaaccctaaagtagttaaaacgtaaaggttactttaacgtttaccgttaaaccgttttccgggaacccgttaggtaaaccctaagttcggttaggaacttacgtaacggaaaaccgttcgttagggttacgacgttaggacccttaaccgtacgtttacttaccggttacttaacccg

SEQ ID NO: 167693 - DNA, 776 bp, Homo sapiens
  misc_feature: GYAE6OF02JGCBS.16.81.H04.1.454.CMB.1.raw
  modified_base (270)..(270): a, c, t, g, unknown or other
  misc_feature (270)..(270): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaccagggaaacncccctaagcctcctgatctatgatgtctaccaattacgtaggaaacggttcggggtacccctaatcgtaaggttaccaggtcggccgtaaggttcggagttacggtggggaaccaaggtaacttttaccgaaccttccgttaccaaacccaagtttaccgaacggacctaacggtaccccttaaacgaccgtacccgttagtaacgttagtaacgtttttacggacgtttaaccttttaagtttaacttacgtaacccgtaaacgttaaacggttaaagtttaaaacgggtacgtttttaacgttttaacccgtaaaccggtttttttaccccgggaccccgtttaaacgggggtaaacccgttaaacgtttacggggttacgggtaaacgtttaaccgtaaacccggttaaaaaccggtaaacggtttcgggttacggttaccgtttaaccggaccttaaaccccgttacgtttaccgtttacccggtttacccgttttaacccg

SEQ ID NO: 167694 - DNA, 619 bp, Homo sapiens
  misc_feature: GYAE6OF02HFLK5.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccgggccagtcagtagtgttggtacctggttggcctggtatcagcagaaaccagggaaagcccctaagctcctgatctatgatggtctaccaatatggaaagtggggtacccagtcaaggttcagcggcagtggatcgtaggacagtaattcacgtctcgaccatcagcagcctacgacgtcctgatgtagttttcgacgtagtttacgttattacggaccctaactaacgtaattaaagggttacgttttaactttaacgttaaaccgttttcccgggttaccccgttacggggtaaacctaacgttaggttacggtaattaaccgttaacgaaaaaccggttaacgttacggtacggtacgtacggtaccgtacccttaacgttcccgttacgtccttttaacccg

SEQ ID NO: 167695 - DNA, 531 bp, Homo sapiens
  misc_feature: GYAE6OF02GIBHC.16.81.H04.1.454.CMB.1.raw
  modified_base (268)..(268): a, c, t, g, unknown or other
  misc_feature (268)..(268): n is a, c, g, or t
  modified_base (387)..(387): a, c, t, g, unknown or other
  misc_feature (387)..(387): n is a, c, g, or t
  modified_base (435)..(435): a, c, t, g, unknown or other
  misc_feature (435)..(435): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcagaaaccagggaaancccctaagctcctgatctatgatcgtactccaatatagggaaacgtggggtacccatcgaaggttcaggcggagagtggatcgtggacagtaattcactctcaccatcagcagcctacngtcctgtatgtattttgacgtactttattattgacctaatacgttaanaagtacgtttattacgtaactttcggacccttagggaacctagtgtaggtataacgtaacgaaactacgtgtacgctcgccaccatcgttctctac

SEQ ID NO: 167696 - DNA, 714 bp, Homo sapiens
  misc_feature: GYAE6OF02IT0P7.16.81.H04.1.454.CMB.1.raw
  modified_base (197)..(197): a, c, t, g, unknown or other
  misc_feature (197)..(197): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttggccggcagtcagagtgttgtacctggttggcctggtatcgagacagaaaccgacggaacgcccctaagcctacctgatactagtgtatcgtctacctaatagtaggtaaaggtcggggtacccagtacgaaggttcacggtcggcgtaggtcggtacgttacggtaggggaactaaggtaaccttacgtacgttaccgtaccacccaacgttaccaacggaccctaacgtacccttacgaaccggtccgttaggaacttggttaacgttttcggaccggtttaaacttttagttacctttcgaaacccgtaaaccgttaagttaaacgttaaacggttaagtttttaaccgttacccgttaaaccgttttacccgggcccgtttaacggggtaaccccttaaggttacgggttaacggtaacttaaccgttaaccgaaaacccggtttagttacgggttacggccgtttacggacccgtaacccgttagtttacccgg

SEQ ID NO: 167697 - DNA, 638 bp, Homo sapiens
  misc_feature: GYAE6OF02HYSZU.16.81.H04.1.454.CMB.1.raw
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcggccgggccagtcagtagtggttggtaccgttggttggcctgggtactcagcaagaaaccgagggaaaccncccctaaggcctacctgatcctaatgattgtctaccaatagtagggaagtcggggtaccatcgaaggttnacgcggtcgtaggtgtactcggtcgggaacagtaacttacaccgttactcacctatacgacgccacgtaccctactacgccttagagttcgttacgttttacgcgttaattttacgtttattacgacctaaagtacgttaataaaggttacttttacttaccgttaaccgtttccgggtcccgttaacggaacccttaagttcggttaggtaacttaacgtaacgtaaaccgtagtcggtttacgaccgttacgaccttaacccgtagtccttacgtactttacccg

SEQ ID NO: 167698 - DNA, 550 bp, Homo sapiens
  misc_feature: GYAE6OF02IWGY0.16.81.H04.1.454.CMB.1.raw
  modified_base (267)..(267): a, c, t, g, unknown or other
  misc_feature (267)..(267): n is a, c, g, or t
  modified_base (546)..(546): a, c, t, g, unknown or other
  misc_feature (546)..(546): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcgagacagagtcaccatcacttgccgggccagtcagagtgttggacctggtggcctggtatcagcagaaaccagggaaacncccctaagctcctgatctatgatcgtactccgaatacgtaggaaagtcggggtacccagtcaaggttcaggcggcaggtggatcgtaggaacagtaaattcgaactcgtacaccgtatactacgcaacgaccctaacgacgtcctagattcgtaattttcgacgtaatttatttacttcaccaatagtaataaggtatttatacgtaacttcggacctggactaagttgtagatatacgaaacgtacgtgtggctagacctaactacttctagttcctntacc

SEQ ID NO: 167699 - DNA, 552 bp, Homo sapiens
  misc_feature: GYAE6OF02F6ZJI.16.81.H04.1.454.CMB.1.raw
  modified_base (388)..(388): a, c, t, g, unknown or other
  misc_feature (388)..(388): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgcccctaagcctcctgatctatgatgtctaccaatagtaggaaagttcggggtccagtacaaggttcagtcggacagtggatcgtgggacagaatcactctcacatcagcagtcctancgtcctgactgtatttgacgttattattacttgacctaacgtagttaataagttagtttaacttactaaccgtttcggacccgttagggaacctaagttcggtagtataacgtaacaaacgtaacgtgtacggtctacggacctacctatcgttgttcttaccg

SEQ ID NO: 167700 - DNA, 624 bp, Homo sapiens
  misc_feature: GYAE6OF02HODB1.16.81.H04.1.454.CMB.1.raw
  modified_base (191)..(191): a, c, t, g, unknown or other
  misc_feature (191)..(191): n is a, c, g, or t
  modified_base (271)..(271): a, c, t, g, unknown or other
  misc_feature (271)..(271): n is a, c, g, or t
  modified_base (585)..(585): a, c, t, g, unknown or other
  misc_feature (585)..(585): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcgganacagagtcaccatcacttgccgggccagtcagagttgttcggtacctgggttgcctggtatcagcagaaaccagggaacncccctaagctcctgatctatgatgtactccgaattagaggtaaaggtcgggtccagtcaaggttcaggtcggcaggtgatcgtggactagaacttcactcctacaacgatcagccagtccctaacgacgtacccgtagtaacgttgtacttttacggaccgtttaaacttttaagtttacgttaccgtaactaaaccgtaagttaagttaaacgttaacggtttaactttaacgtttaaccgttaccgggttcccgtacgggtaaacaaggttacgtgtaacttagtaaccaaacggttactacggtcgtacgnggtacctacgttcctacgtttacgttccttacgtacccg

SEQ ID NO: 167701 - DNA, 664 bp, Homo sapiens
  misc_feature: GYAE6OF02GSGF0.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagtagtgttcggtaccttgggttcggccgtggtatcgagcgaagaaaccgagggaaacgcccctaagcctacctgatctagtgatcgtctaccaatagtagggaagtcgggtacccagtacgtaaggtcaggcggcgtagtggatcgtaggacaggtaacttcacctcgtaccactactcaacgtaccgacgtacctaacgcgtcctaggtatcggtttaagtttacggtaccgttacttttaagttattaccgtaacctaatacggttaataaaggttaacgtttacttaaccgttaaccggttttaccggtacccgttaacgggtaacccttaaggttacgtacgggtaattaacggtaacctaaaaccggtacgttacgggttaacggtacccgttacggtaccaaccgttaacgtttccgttacgtttacccgttacccg

SEQ ID NO: 167702 - DNA, 620 bp, Homo sapiens
  misc_feature: GYAE6OF02H5M1B.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcctagtcagagtgttggtacctggttggcctggtatcagcagaaacgagggaaacgcccctaagcctcctgatctatgatgtctcaatagtaggtaaaggtcgggtccagtcgaaggttcaggttggcctaggtggagtcgtagggacagtaacttcaactctacctaccactcaacgcaacggtcctacgacgtcctagacttgtaattttggaccgttaacttttaattacgttacgtaaccctaaagtagttaaactaaaggtaagttttacttaccgttaacgttttcccggacccggtacgggtaacccaggttaggtaggtaacgttaagtaaccgtaaaaccgtacgtaggttcgccgtaaggtcccaacccgtaacgtttcctacgttccttaaccg

SEQ ID NO: 167703 - DNA, 512 bp, Homo sapiens
  misc_feature: GYAE6OF02FR8SF.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatcgtggacagaattcactctcaccatcagcagccctacagcctgatgattttgcgtactttattattgaccaacgagttaataaagtagtttacttactaacgtttccggacccttagggaaccaagttcgtaggatagtacaaacgactgtagctgcacatctgtcttacg

SEQ ID NO: 167704 - DNA, 555 bp, Homo sapiens
  misc_feature: GYAE6OF02H438W.16.81.H04.1.454.CMB.1.raw
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccgggccagtcagagtgttggtacctggttggcctggtatcagcaacgaaaccagggaaacgacccctaagcctcctgatctatgatcgtctacctaatagtaggaaacggtcggggtaccagtacgtaaggttcaggtcggactaggtggtatcggtaggaactaggtaactcactctacacctatcaagcaacgcctacgactcctagtatgttactttgaccttaatttatatcgaccaaatagttaataagtagtttactcgtaaacgtttccggacctaggactagttgtgtaatactaacgaaacgtcgtcgtacgctagacctacgtattc

SEQ ID NO: 167705 - DNA, 570 bp, Homo sapiens
  misc_feature: GYAE6OF02GN080.16.81.H04.1.454.CMB.1.raw
  modified_base (349)..(349): a, c, t, g, unknown or other
  misc_feature (349)..(349): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggtggcctggtatcagcagaaaccgaagggaaacgccccgtaagcctacctgatctatgatgtctacaatagtaggaaagttcgggtaccctagtaccgaaggttcaggcggntaggtggactgtagggactagaacttctactcctaccaacactacaagccagccctaacgtacgacctgtatagtacttttgacgtactttaattacttcgaccaataagttaagttaagtagtttacttactaaccgtttaccgccgtacgggactaagttggtagtatacgtaacaaacgtacgtggtacgcgtacgaccacctatcgttgtccttacc

SEQ ID NO: 167706 - DNA, 606 bp, Homo sapiens
  misc_feature: GYAE6OF02F1RYA.16.81.H04.1.454.CMB.1.raw
tcagtgtactactccacgaccggtgctcgatttagtagtgtagattcgcgggggtcagactcagtcaggacacagcatggacatgagggtccccgctcagctcctgggggctcctgctgctctggctcccaggtatcaaatgtgacatccagatgacccagtctccttccaccctgtctgcatctgtcggagacagagtcaccatcacttgccgggcagtcagagtgttggtacctggttggcctggtatcagcaagaaaccaggggaaacgcccctaaagcctcctgatctatgatgtctaccaatagtaggaaagtggggtcccagtaccaaggttcaggccggcagtggatcgtaggggacaaggtaattccactactccaacctatcgacgacctagaccctacgacgccttagatggtatttttagcgtactttatttacttacggtacccaacgtaagttataaaggtagtttaactttcgtaaccgttttccggaacccgttcgggtaaccagttaggtcgtaattaacgtaccgtaaaacggtaacttcgggtacgtaccttcggccctaaccgtacttaccggttgttcccttaccg

SEQ ID NO: 167707 - DNA, 706 bp, Homo sapiens
  misc_feature: GYAE6OF02H5PFO.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtgacatccagatgacccagtctccttccacctgtctgctatctcgtcggagacagacgtcaacctatctaacgttcggccgggcctaggtcaaggtacgttgttaggtaccttggttcggcctggtactcgagacgaacgaaaccgagggaaaccgtccctaagccgtacctaggacttacttatgtatcgtctacaagtatagggaacggtcgggtaccagtacgaaggttcgaggtcgcgtacggtgacgttacgagggaactagtaactcaaccgtctaccaactatcgaacgccaacgtacctacgagtaccgtagtaacttgttacgtttacgaccgtttaatttaacgtacttaacgaccgtaaaagtacgttaaaagtaagttacgtttaacgttaaccgtttaacgggtttcccgacccggttaaagggtaacccttaaggtttaacggtacggttaacgttaaaccgtaaacggtaaaaccggttacggttacgttaaccgggtccgttacggaacccttaacccgttaagtttccgttactttccgttaaaccccg

SEQ ID NO: 167708 - DNA, 722 bp, Homo sapiens
  misc_feature: GYAE6OF02H1QJS.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctccaggtatcaaatgtgacatccagatcgaccagtctccttccaccctgtctgctatctggtacggagacaggactcaaccatcctacgttcggccgggcaggtcaggtagttgttaggtccgttgggttcgcgtggtatcagacgaagaaaccgaaggggaaaccaccccgtaagcctacgtagatactatagatcgtactacaagtagtagggtaacggtcgggtacctagtacggtaacggttacgacggccggtagtaacggtggtacgtcggtacgggaacacggtaaacttccgtacttacctaccgtaacctacgtaccgtaggaccaacgtaccctaacgacgtaccgtagtacgttaggttagttttaccggccgtttaaattttacgttacgtttaccgaaccttaacgtaacgttaaagttaaacggtttacgtttaactttaccgttaaccggttttcccggtaaccggttaacgggtaaccttaaggtttcggtacgttaacgtaacggtaaccgaaacgttacgtacgggttaccgagttaccggacctaaccggttacgtttccgttggttacctttaccg

SEQ ID NO: 167709 - DNA, 777 bp, Homo sapiens
  misc_feature: GYAE6OF02GEYFQ.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcgccgggccagtcagtagttgttcggtaccgtggttggccgtggtatcagacaagaaaccgagggaaaccgccctaagcctccgtagatctatgatcgtactaccaatacgtaggtaacggttcgggtacccagtacgtaacggttcgaggacgggactaggttaggacgttcggtacggggaactaaggtaacttcctacgttcctaccgaacctacgtaccacggtacctaacggtacccctaacgaccggtaccgttacggtaacgtttacggttaacgtttttcggaaccgtttttaaacttttaacgtttaacgtttaccggtaaaccctaaacgttaaaggttaaactttaaacgggtttagttttaaaccttttaaccgttaaccgtttttaccccggggtaaccccgtttacggggtaaaccgttaacgtttacggggttaacgtaaacggtttaaaccgtaaaacccggttaaaacggtaaccgtttacgggtttacgggttaccgtacggtacccccgttaacgttaccccgtttacgtttaccggttttaccccg

SEQ ID NO: 167710 - DNA, 694 bp, Homo sapiens
  misc_feature: GYAE6OF02JKLSV.16.81.H04.1.454.CMB.1.raw
  modified_base (428)..(428): a, c, t, g, unknown or other
  misc_feature (428)..(428): n is a, c, g, or t
tcagtgtactactccacgaccggtgctcgatttagtagtgtagattcgcgggggtcagactcagtcaggacacagcatggacatgagggtccccgctcagctcctggggctcctgctgctctgactcccaggtatcaaatgtgacatccagatgacccagtctccttccaccctgtctgcatctgtcgagacgagagtcacatcacttcgccggcagtcagagtgttggacgtggtggcctggtatcagcgagaaccgaggaacacccgtaagctcctagactctatgtatcgtctaccgaatagtaggaaacggtcggggtaccctagtacgtaaggttcgaacggccggtacgtaggttaggtacgttacggtaacgggacgtaagtaacgtttccgtaccttacttaccgaacctactacgaacncgtaaccgacccgtacgacgtaccgtagtacgttacgttagtttacggtacgttactttaattacgttactaccgaaacgtaagttaacgttaaagttacgtttacttaaccgttaaccggtttccggtcccggtaaggtaacccgttaaggttacggttacggtaacgttaaccggttaaaccgttaaacggtaacgttagggttacgtaccgttaacgggaccccttaaccgttacggttaccgtttaccgttccgtttaaccc

SEQ ID NO: 167711 - DNA, 771 bp, Homo sapiens
  misc_feature: GYAE6OF02HW6L9.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatcacttgccggccagtcagagtgttggtacctggttgctggtatcagcaagaaaccgagggaacaccctaagctcctagatactatgatgtctacaatagtaggaaaggtcgggtaccagtacgaaaggttcacgcggactaggtggtactcgtaggggaacaaggtaactttccgaaccttctaccgaacctacgtacacggacctacggaccctaacgtacgtcccgtaggtaacgttaggtttaagttttacgaaccggttttaacttttaaacgttttaacgttacggtaaaccctaaaacgttaaggtttaaaagttaaaacgggtttaagtttttaaaccgtttaaccgtttaaacccggtttttacccggggtacccccggtttaaacggggtaaaccccttaaaagtttacgggtttaacgggtaaacttttaaaccggttaaaacccggtaaaaaaccggggtttaaacgttccggggttaaccgggtaccgttacccggtaacccgttaaacccgtttacgtttacccggtttaccggttttaccctttaaccccgg

SEQ ID NO: 167712 - DNA, 546 bp, Homo sapiens
  misc_feature: GYAE6OF02G1HIP.16.81.H04.1.454.CMB.1.raw
  modified_base (312)..(312): a, c, t, g, unknown or other
  misc_feature (312)..(312): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatcgacccagtcctccttccaccctgtctgcatctgtcggagacagagtcaccatcacttggccgggcagtcagtagtgttggtacctgggttcgcctggtatcgagcaacgaaaccgagggaaacgcccctaagcctcctgatctatgatgtctcaatntagggaagtcgggtcccagtacgaaggttcagcggcaggtggatcgnggaanagtattcgactctacacatcagcacgcctaacncgtcctgtatgttatttgacttactttattatanaccctaatagtaataagtagttacttacgttaacgttccggaccctggaaccttaggtgtagtaatacgtaacgaaacgtatcggtagcgtacgctaacctgtctcttcttaccg

SEQ ID NO: 167713 - DNA, 683 bp, Homo sapiens
  misc_feature: GYAE6OF02HK0SO.16.81.H04.1.454.CMB.1.raw
  modified_base (273)..(273): a, c, t, g, unknown or other
  misc_feature (273)..(273): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagatcaccatcacttcgccgggcagtcagagtgttcggtaccgtggttgcctggtatcagcaacgaaaccgagggaaacncccctaagcctcctgtactctagtgatcgtacctacctaagtagtaggtaaaggtcgggtaccctagtacgtaacggtcgacgcgggactaggtggaacttcggtaggaacgaaggtaacttaccgacgttctaccgaacctactaccaggtacctacgaacccgttacaccgttccgttaggtacgtttacgttaacgttttggtaaccgtttaattttacgttttactacgaaccctaaacgtaagttaaacggttaaacgttaacggttttaactttaaccggttaacccgttttaccggggaccctttaacgggaaaccttagttaggtacgtaagtaaccgttaacgtaaacgtaacgtgtaggtcctacgaacctaccgtagtttccgttacgttaccttaccg

SEQ ID NO: 167714 - DNA, 745 bp, Homo sapiens
  misc_feature: GYAE6OF02GTQ0N.16.81.H04.1.454.CMB.1.raw
  modified_base (279)..(279): a, c, t, g, unknown or other
  misc_feature (279)..(279): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtcctccttccaccctgtctgcattctgtcggagacagacgtcaccatcacttcggccgggcagtcagagtggttcggtactggttggcctggtatcagacaacgaaacgacgggaacnccctaagcctcgtagtatctatgtatcgtcctactaataggtaggtaaacggtcgggtacctagtacgtaacggttcgacggacgggtacgaggttcggtaacgtttcggtacgggaacgtaaggttaaacttcccgtaaccgttacctacccgtaaaccctacggtaccaacggtaccgtaacccgttcccaaacggtccgtacccgttagggtactttacggtttacttttcggtaaacccgtttagttttaacttacgtttacgaaccgtaaacgttaacgttaaggttaagtttaaccgtttaactttaccggtttaacccgttttcccgggtaccgttaaccgggtaaaccttagggttacggttacggtaactttaaccggtaaaccgttaaaccgtaccggttcggtaacggtccgttaacgaccgttacccttagttccgtttacgtaccctttaccg

SEQ ID NO: 167715 - DNA, 542 bp, Homo sapiens
  misc_feature: GYAE6OF02FK1P5.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagcccctaagctcctgatctatgatgtctccaatatggaaagtggggtcccagtcaaggttcagcggcagtggatcgtagggacagaattcactctcaccactcagcacgcctaacgacgtcctgatgtattttagccgtactttattattcgaccaactagttaagtaagtagttactttacctaacgttttccggacccttagggtaacctaagtggtagtatacgtaacaaacgaacgtgtacggacttgaccacctactcgttcgtacttcc

SEQ ID NO: 167716 - DNA, 599 bp, Homo sapiens
  misc_feature: GYAE6OF02F49UC.16.81.H04.1.454.CMB.1.raw
  modified_base (370)..(370): a, c, t, g, unknown or other
  misc_feature (370)..(370): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttggcctggtatcagcaagaaaccgagggaaacgcccctaagctcctgactctagtgatcgtctaccaattagaggtaaaggtcgggtaccagtacgaaggttcaggcggacgagtggatcgtggganagtaattcactcacaaccatcagcacgccacgacgtcctagtagttgtattttacgacgttaactttagttacttacgaacctaaagtacgttaaagttaagttaacgtttaacttaccttaaacggtttccggaccgttacggtaccgtaaggttacggtaacggtaattaacgtaaccgtaaacgtaacgttacggtacggtaccttacggacctaaccgtcttacg

SEQ ID NO: 167717 - DNA, 603 bp, Homo sapiens
  misc_feature: GYAE6OF02FIKNI.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtactcagcagaaaccagggaaagcccctaagctcctgatctatgatgtctccaatataggaaagtggggtccatcaggttcagcggcagtcggatcgtagggactaggaattcacgtctacaccatacacgctacgcctaccagtcctagattgacttttagcgtaactttacttaattcgaccctaaactaagttaactaaaggttacgtttaatttaccgtaacgttttccggaccccgtttacggggaacccttaagttaggttacgtaacgttactaaccgaaaccggtaacgttcggtacggtccgtacggtacccgtaaccgtaccgttcgttacgttaccctttacccg

SEQ ID NO: 167718 - DNA, 593 bp, Homo sapiens
  misc_feature: GYAE6OF02FH6IY.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccgggccagtcagagtgttggtacctggttcggcctggtatcagcaagaaaccagggaacgccctaagctcctgatctatgatcgtctacctaatagtagggaaaggtcggggttacccagtacgtaaggttcgacggcggcaaggtggatcgtagggacaagtaattcactctacctacatcagcacgacctacgacgtcctagacttgttactttgacgttaactttagtttacgttcgacctaaatagttaataagtagtttacttactaaccgtttcgcccgttaggactaagtgtaggtatacgtaccgtaaacgtaacgttggtacggtactacggacctaaccgtacgttcgttaccggttacttaccttacccg

SEQ ID NO: 167719 - DNA, 639 bp, Homo sapiens
  misc_feature: GYAE6OF02IX848.16.81.H04.1.454.CMB.1.raw
  modified_base (268)..(268): a, c, t, g, unknown or other
  misc_feature (268)..(268): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgcatctgtcggagacagagtcaccatcacgttgccggccagtcagagtgttgtacctggttcggcctggtatcagcacgaaccagggaacnccctaagctcctgatctatgatgtactaccaagtagtacggaaagtcgggtaccagtacgtaaggttcacggcggacaggtaggacgttcgtacgggacaacgtaacttccaccttacctaccgaaccctataccgaacgtccgtacgacccttacgacgtaccctagtaacgttgttaacgttttcgaaccgtttacttttaagtttacgtttacgaccttaagtattaagttaacgttagttttacttacgttaaccgtttccggacccgttacgggtaacccttaaggttcggtagtacttaacgtaacgtaaacgtacgttacgtacggtctacggacctaaccgtgtttaccttcgttccttaccg

SEQ ID NO: 167720 - DNA, 633 bp, Homo sapiens
  misc_feature: GYAE6OF02H8APJ.16.81.H04.1.454.CMB.1.raw
  modified_base (272)..(272): a, c, t, g, unknown or other
  misc_feature (272)..(272): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtactggttgcctggtatcagcagaaacagggaacnccctagctcctgtatctatgatcgtctaccaatacgtagggaaacgtcggggtacccagttaccgaaggttcagtcggctaggtgactcgtaggacagtaactctacgtcctacacctatcgacgcaacgtcctacgacgtcctagattaggttacttttcggaccttaaccgtttaatttaccgttacgaaccctaaacgttaagttaacgtaaaggtttaagtttaacctttaaccgttaacgttttcccgggacccgttacgggtacctaacggttacggtaaggtacgttaactaaacccggtaaacgttaacgttacgggtacggtaccgttcgtaaccctaccctagtttacccg

SEQ ID NO: 167721 - DNA, 716 bp, Homo sapiens
  misc_feature: GYAE6OF02GUASE.16.81.H04.1.454.CMB.1.raw
tcagtgtactactccacgaccggtgctcgatttagtagtgtagattcgcggggggagtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtcaccatctacttcggccgggccagtcagtagtggttcgtacgtggttggccgtggtatcagacaagaaaccgaagggaacgccctaacgctccgtgatctatgtatcgtcacctaatagtagggtaaggtcgggtaccagtacgtaaggttcgaggcggacgaggtaggtacgtcgtagggaacaagttaactacgaccttaccgtaccaacctataccgacgacctacgtacccgtacgtaccggccttaaggacgtttaacggtttacgttttcggttaacccgtttaacttttaacgtttaacgtttacccgtaaaccgtaaagtaacggtttaaaaccgttaaggttttaacgtttaacctttaaccgtttaacccggtttttacccggggaaccccgttaacgggtaacccgttaaggttacgttaggttaactaacgtaaaccgtaaaccggttaacgttagggtaccggtacgtacgtacccgtaacctgttaccgttgtttacccg

SEQ ID NO: 167722 - DNA, 731 bp, Homo sapiens
  misc_feature: GYAE6OF02H6WD8.16.81.H04.1.454.CMB.1.raw
  modified_base (190)..(190): a, c, t, g, unknown or other
  misc_feature (190)..(190): n is a, c, g, or t
  modified_base (283)..(283): a, c, t, g, unknown or other
  misc_feature (283)..(283): n is a, c, g, or t
  modified_base (710)..(710): a, c, t, g, unknown or other
  misc_feature (710)..(710): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgcatctgtcgganacagacgtcacatcacttggcccggcagtcagtagttgttacggtacctgggttcggccgttggtactcgagacaagaaaccgaagggaaccncccctaaggccttccgtagacttacttagtgtacttacgtcctaacctaagttaacgtagggtaaacggttcgggttacccaagtaccggtaaggttccgaggtacccgggtacgtaacgggtacggtacgttacggtaggggtaaacaacggttaaactttcccgtaacgttccctaccgtaacctacgttaccgaacgtaccacggttaccctaacgaacggttcctaggtacgtttcggttcgttttacggacccgtttaacttttagttaccgtttaccgaacttaaaccgttagttaaacgttaacgttacgttttacgttaacccgttacggtttcccgtaacggtaccggtaacgttaagttcgtacggtaattaacggtaaacctaaccggtatggtacggtcgttcgaccctaacgtnttaccgttccttacttacccg

SEQ ID NO: 167723 - DNA, 511 bp, Homo sapiens
  misc_feature: GYAE6OF02GL8WQ.16.81.H04.1.454.CMB.1.raw
tcagtgtactactccacgaccggtgctcgatttagtagtgtagattcgcgggggtcagactcagtcaggacacagcatggacatgagggtccccgctcagctcctgggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtccatcaagttcagcgcagtgatctgggacagtaatcactctcaccatcagcagcctacacgcctgattgattttgacgtactttattattgaccaactagttaataagtagtttattctaacgtttccggaccctgggaacctaagtggtagatagtacaaacgtactggtcggactgccacctatctagtcttac

SEQ ID NO: 167724 - DNA, 582 bp, Homo sapiens
  misc_feature: GYAE6OF02HUUVV.16.81.H04.1.454.CMB.1.raw
  modified_base (272)..(272): a, c, t, g, unknown or other
  misc_feature (272)..(272): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagacgtcaccatcacttcgccggcagtcagtagtgttggtacctggtgcctggtatcgagacaagaaccgagggaacncccctaagctctgatcatgatgtctacaatagtaggaaacggtcgggtacccagtacgtaacggtcagcggtgtagtggactcgtacggacagtaacttcacgttccacaaccatacacgtacaacgtacctacgacgtacctagattacgtactttacggacgtttaactttattacgttaccgaacctaaacgttaagttaaactaaagtagtttaacgtaccttaacgttccgacccgttagaacctagtcggtagtataacgaacgtaacgacgtgtcgattcgaccaccagttcctagtcttacg

SEQ ID NO: 167725 - DNA, 575 bp, Homo sapiens
  misc_feature: GYAE6OF02HQRSO.16.81.H04.1.454.CMB.1.raw
  modified_base (275)..(275): a, c, t, g, unknown or other
  misc_feature (275)..(275): n is a, c, g, or t
  modified_base (426)..(426): a, c, t, g, unknown or other
  misc_feature (426)..(426): n is a, c, g, or t
tcagtgtactactccacgaccggtgctcgatttagtagtgtagattcgcggggggtcagactcagtcaggacacagcatggacatgagggtccccgctcagctcctgggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcgagcaagaaaccgagggaaacncccgtaagctcctagactactatgtatcgtcctaccaatagtaggaaaggtcggggtaccagtacgtaaggttcacggcggacgtaggtcggactacggtaggggaactagtaacttcacttcctacaccatacagtaccacgtccctacngcctgatgtatttgacgttacttattacttcgacctaatagttaataagtatttacttacgtaacgtttccggtacccgtaggtaacctattcggtatataacgtaacgaaacgtagtcgtacgcgtacgcaccgtctactgttacctc

SEQ ID NO: 167726 - DNA, 718 bp, Homo sapiens
  misc_feature: GYAE6OF02ITE6K.16.81.H04.1.454.CMB.1.raw
  modified_base (414)..(414): a, c, t, g, unknown or other
  misc_feature (414)..(414): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcacgagtgttggtacctggttgacctggtatcaggcagaaaacccgagggaaaacgcccctaaagcctacccgttaggacttaccgtagttcgtaattggtacctacctaataagtacgggaaaagtcggggtacccaagtcaaaggttccaggtcgacagtaggacttcggtacggaacagtaatcctaactntccgaaccatcaaggccaggtcctacagacctagaacttacgagttttacgacgtaactttacgttaacttcggaaccctaaacgagttaaacttaaaggtacggttttaacttacgaaccgttttaccgggtaaccccgttacgggggtaaaccctaaaggttacccgtaggggttaacctttaaacgtaaaccccggttaaaacgtaaacggttccggttaaacggggtacccgttaacgggttaacccgtaaacccgtttaacggttaaccccgtttggtttaaacccggttttaaccccg

SEQ ID NO: 167727 - DNA, 627 bp, Homo sapiens
  misc_feature: GYAE6OF02ISQLA.16.81.H04.1.454.CMB.1.raw
  modified_base (179)..(179): a, c, t, g, unknown or other
  misc_feature (179)..(179): n is a, c, g, or t
  modified_base (620)..(620): a, c, t, g, unknown or other
  misc_feature (620)..(620): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgnatcgtgtcggagacagacgtcaccatcacgttcgccgggccagtcaggagttgttcggtaccgttggttcggccgtggtatcgagccgaacgaaaaccgaagggaaaccgcccctaagcctccgtgactctatgatcgttcctactaatagtaggaaggtcggtaccagtacgtaaggtcgacgcggctaggtggtactcgtagggacagtacttcgactctacgaccactcgacgcaacgcctacgacggtcctagtacgttgttacgtttcggaccgttaactttagtttactaccgaacctaataaggttaataaacggttatttacctttacgttaacccgtttaccgggcccgtaggtaacccgtagttcggtagtactaacggtaaccttaaaccgtagtggtacggacttcgacctaccgtagtcgttaccgtntttaccg

SEQ ID NO: 167728 - DNA, 591 bp, Homo sapiens
  misc_feature: GYAE6OF02IGBJR.16.81.H04.1.454.CMB.1.raw
  modified_base (96)..(96): a, c, t, g, unknown or other
  misc_feature (96)..(96): n is a, c, g, or t
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (269)..(269): a, c, t, g, unknown or other
  misc_feature (269)..(269): n is a, c, g, or t
tcagtgtactactccacgaccggtgctcgatttagtagtgtagattcgcgggggtcagactcagtcaggacacagcatggacatgagggtccccgntcagctcctggggctcctgctgctctggctcccaggtatcaaatgtgacatccagatgacccagtctccttccaccctgtctgcatctgtcgganacagagtcaccatcacttgccgggccagtcagngtcgttggacctggttggcctggtatcagcagaaaccagggaaancccctaagctacctgatctatgatgtctccaatatggtaaaggtgggttacccagttacgaaggttcaggtacggctaaggtggatcgtaggacaagtattcactcgtacaccatcagcacgcctacacgtctagacttaggtattttcggactacttattacttagacctaactaacggttataaacgttagttaactttaccgtaacttttaccggtacccgtaggtaaccctaagtcgtaggtaacttaacgaacttaaacggtaacctaggttacggtacttcggaccctaccgtacgtaccttgttcctttaacccg

SEQ ID NO: 167729 - DNA, 602 bp, Homo sapiens
  misc_feature: GYAE6OF02HLLU9.16.81.H04.1.454.CMB.1.raw
  modified_base (396)..(396): a, c, t, g, unknown or other
  misc_feature (396)..(396): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagttgttgtaccgtggttcggccttggtatcgagacaacgaaaccgaagggaaacgaccccctaaagcctcctagatactatagatcgtctacctaatagtagggaaggtcgggtacccatacgtaaggttcgaggcgacaggtgatcgtaggacagattcactctacactacncagcacgtccacacgctgtatgttacgtttgacgttatttattacgttacgacctaaacgtagttaagttaaagtacgtttttaactaccgttaaccgttttccggacccggttacggaaccctagtcgggtagtacttaacgaaccgtaaacgtaagtcggtacggtactaccgtacaccgttaagtcgtttcgtacctttaccg

SEQ ID NO: 167730 - DNA, 647 bp, Homo sapiens
  misc_feature: GYAE6OF02H5E1G.16.81.H04.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagtgtactactccacgaccggtgctcgatttagtagtgtagattcgcgggggtcagactcagtcaggacacagcatggacatgagggtccccgctcagctcctggggctcctgctgctcgtggctcccaggtatcaaatgtgacatccagatcgaccagtcctccttcccaccctgtcctgcactcgtcgtcggagacagngtccacctatctacgttcggccgggccagtcagtgttggttcggtacctgggttgccgtggtatcgagacgaacgaaaccggaacgggaaacnccccgtaagcctactgatcatgatcgtctactaataggtaggtaaggtcgggacctagtacgtaggttcgacggcggtgaggtcggagtcggtagggactaagtactacgtactaccgtcaaccgtagtacacgacgtaccgtacctaacgtgaccgttagaagttgttacttacgacgtttaacttagttcgttacgactaacgtaattaacgtaagttacgtttaactccgtaacgtttccgaccggtacggtacctagtaccggtagttaacgtacgtaaacgtaaacgttcgtacggttacggtactcgaaccgttaccgtcgtttaccgtttccggtatttacccg

SEQ ID NO: 167731 - DNA, 555 bp, Homo sapiens
  misc_feature: GYAE6OF02GE4V9.16.81.H04.1.454.CMB.1.raw
  modified_base (508)..(508): a, c, t, g, unknown or other
  misc_feature (508)..(508): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgccttggtactcgagcaagaaaccgaagggaaacgacccctaagctcctgactctatgatgtctccaatacgtaggaaaggtcgggtaccagtcgaacggttcaggcggctaaggtggtactcgtagggactagtaacttcactcgtaccaccgatcgacgacacgacctaacgagtccgtagatgtactttgacgttacttattagttcgtacctaaacgtagtaataagtattacttacgtaaccttcggcctacggacatggtanagtactaacgtaacgtactcgtagctcgactacgatctacgtcttcg

SEQ ID NO: 167732 - DNA, 762 bp, Homo sapiens
  misc_feature: GYAE6OF02I03XH.16.81.H04.1.454.CMB.1.raw
  modified_base (198)..(198): a, c, t, g, unknown or other
  misc_feature (198)..(198): n is a, c, g, or t
  modified_base (495)..(495): a, c, t, g, unknown or other
  misc_feature (495)..(495): n is a, c, g, or t
tcagtgtactactccacgaccggtgctcgatttagtagtgtagattcgcgggggtcggactcagtcaggacacagcatggacatgagggtccccgctcagctcctggggctctgctgctctggctccgaggtatacaatgtgacatccagatcgacccagttcctccttccaccctgtctgctatcgtggtacggaanacgagagtccaaccatacacttcggccgggtccagtcgaaggcgttggttacgggtactgggttcggcctggtatcgagacgtaaacgaaacggaacgggtaaccgacccctaaggccttacgagtacttacagtacggattcgtacctaactaacgtaggtaacgggtaacgttccgggtaaccagttaacgtaacgggttcgaacggggtcggtaacgtacggtaggtacgttcgggaacggggtactaaacggttactccggtaaactccggtaacctaaccgaatacccgaanaacccggtctaacgtacgaacgttcgtaagttacgttacgtttacggtattaacgtttacgttactaaccgaacctaaagtacggtaaacgtttaaatttgggtaaacctttcgggtaaaccctttcccggggtaaaccgttacggtaacgtaacttgggtaacgttaacttaacgtaaaccgttaaggttaccgttaaggtaccgtacggtacccgtaacctaacggttacttaccgttctttaacctttccggtacttaccccgg

SEQ ID NO: 167733 - DNA, 738 bp, Homo sapiens
  misc_feature: GYAE6OF02FHE3G.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccacctgtctgcatctgtcggagacagagtcaccatcacttggccgggccagtcagagttgttcggtacctgggttcggcctgggtactcacgcaaggaaaccaggggaaacgccccctaaaggcctcctgactcctatggaattgtacctcctaaatactagggtaaacggtcgggggtaccccaagttacgaaagggtttaccacggtcgggacgaggttgggaagtcccgtagggggaaccaaggtaaactttccaccgttaccgtaccacctacttaccgacgtaccaacggccctaaaccgtacgcccgttagaacttcgttaactttttacggacgttaccgttttaatttaacgtttcggaaccctaaacgtaagttaaacgtaaagttagttttaaaccgttttcgttaaacccgtttttcccgggacccgttaaccgggtaacctaaccggtttgggttacggtaacgtaacgttaaaccgtaaaaccggttaaccgttcggggttaacggtcgtacggaccgtaacccgttagtcccgtttacggttccctttaacccgg

SEQ ID NO: 167734 - DNA, 164 bp, Homo sapiens
  misc_feature: GYAE6OF02IWVIU.16.81.H04.1.454.CMB.1.raw
  modified_base (160)..(164): a, c, t, g, unknown or other
  misc_feature (160)..(164): n is a, c, g, or t
tcagtgtactactccacgaccggtgctcgatttagtagtgtagattcgcggggtcagactcagtcaggacacagcatggacatgagggtccccgctcagctcctggggctcctgctgctctggctcccaggagctgagcgggctgggcaaggcgcatagnnnnn

SEQ ID NO: 167735 - DNA, 542 bp, Homo sapiens
  misc_feature: GYAE6OF02F27X7.16.81.H04.1.454.CMB.1.raw
  modified_base (225)..(225): a, c, t, g, unknown or other
  misc_feature (225)..(225): n is a, c, g, or t
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
tcagtgtactactccacgaccggtgctcgatttagtagtgtagattcgcggggggtaagactcagtcaggacacagcatggacatgagggtccccgctcagctcctggggctcctgctgctctggctccaggtatcaaatgtgacatccagatgacccagtctccttccaccctgtctgcatcgtgtcggagacagagtcaccatccacttgccggccagtcagngtgttggtacctggttgcctggtatcagcagaaaccgagggaaacgcccctaagctcctgatctatgatgtctacaatagtggaaaggtgggtcccatcgaaggttcaggcggngaggtggatcgtagggaccataacttcacttcncaccatcgancagcctacagcctgatgtactttagcgttaactttatttatcgaccaaacagttaagtaagtaagtttactacgtaaccgtttcggacccgttaggactaatggaggtactataccgtaaagacgttggagtctagaccacattctgttaccttcgtacc

SEQ ID NO: 167736 - DNA, 694 bp, Homo sapiens
  misc_feature: GYAE6OF02JA5GD.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatctgtcggagacagagtccaaccatcacttcggcccgggccagtcagtagtgttggtacctggttggcctggtactcagccaagtaaaccgagggaaacgcccctaagctacctagtatcctatgattcgtcctacaatacgtagggaaacggtcggggttaccccaattcgaaacgggttcacggtccggacgtaggtggacttcggtaggggacaaggtaattaccgaccttaccgtaccaacctacgtacgacgaccgtaacgaccctaacgacgaccttcgtaacttacggtacttttggacctttaacgtttatttaacgtctaaccgtaaacgtaagttaacttaaagggtaagtttactttaacggttaaccttttacccgggaccgttaaccgggaaccttaagttacggtagggtaacttaacgttaaccgaaaaccggtaacgttacggtagttacccgttacggtctaaacccgtacttacccgttgttacccttaacccg

SEQ ID NO: 167737 - DNA, 899 bp, Homo sapiens
  misc_feature: GYAE6OF02I8TZL.16.81.H04.1.454.CMB.1.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
tcagtgtactactccacgaccggtgctcgatttagtagtgtagattcgcgggggagtcagactcagtcaggacacagcatggacatgagggtccccgctcagctcctggggctcctgctgctctggctcccaggtatacaaatgtgacatccagatcgacccagtctcctccaccctgtctgctatctgtcggagacagacgtcaccatctacgttcggccggaccagtcagtagttgttaggtaccgtggttcgtccgtaggtatcgagacgnaaacggaaaccgaaggggaaaccnccccgtaaagcccttacgtacgtactactaagtaggaacttcggtaacctaccaaagttacggtaacgggtaaaacggttcgggggtaaccctaaggttaaccgtaaacgggtttaccgaaacgggtccggaacgttaacgggttacggtaacgttacgggtaacggggtaaacctaaaggtaaacctttaccggtaaacctttacccgtaaccctaaacccgttaacgtaacccgtaaacggaacccgtaaaccggtaaccccttaaacggtaacccgttaacccggttaaggtaaacgtttacgggtttaaacgtttttaccggtaaaccgttttaaaacgtttacgttttaaaccgtaaccgtaaaacccgttaaacgttaaacggtttaaaacgttaaagggtttaaaccgtttttaaaccttaaccggttttaaaacccggtttacccgggtaaacccggtttaacgggaaacccgtttaacggttacgggttaaacggtaactaacggttaaaacccgtaaaaccggttaaccggttaaggttaccggttaccgttaccggtaacccttaaccgttaccgtttaccggtttaacc

SEQ ID NO: 167738 - DNA, 610 bp, Homo sapiens
  misc_feature: GYAE6OF02GCPTQ.16.81.H04.1.454.CMB.1.raw
  modified_base (189)..(189): a, c, t, g, unknown or other
  misc_feature (189)..(189): n is a, c, g, or t
  modified_base (398)..(398): a, c, t, g, unknown or other
  misc_feature (398)..(398): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctcctccacctgtctgcatctgtcgganacagagtcaccatcacttcggccgggccagtcagtagtgttcggtacctgggttgtcctggtatcagacaagaaaccgagggaaacgccccgtaagctaccgtgatcgtacgtgattcgtcctactaattagagggtaacggtcgggtaccaagtactaagggttcagacggcaggtgacttgcgggacaagtattcgacctctcaacngtcagcagaccctacagtcctatagtacgtagtttcgacttaactttagttactacgtaacctaacgttaagtaataacgtacttttacgtaactttaaccggttacgtacccgtaggtaaccctaagttcgtacgtaacgttaaacgtcccgtaaaagttacgtacggtcggtcctacggaccaaccgttacggttacttgttacgttacc

SEQ ID NO: 167739 - DNA, 613 bp, Homo sapiens
  misc_feature: GYAE6OF02ITEP3.16.81.H04.1.454.CMB.1.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (455)..(455): a, c, t, g, unknown or other
  misc_feature (455)..(455): n is a, c, g, or t
  modified_base (581)..(581): a, c, t, g, unknown or other
  misc_feature (581)..(581): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtgacatccgagatgaccctagtcctccttccacccttgcctgctatctgtcgganacagagcacctattcacgttcgccggaccagtacgagtagtggttcgtactggttcggctggtancagcgaagaaccgagggaactacctaacgctaccgtanacttctagaggtnacttacctaanaagttaggaaggtaagggttccggaaccataacggtaacgtggacgtccggaagtggtcgagtaccggtaggactaacgtntaccgtactaccgacacctanacgacgaccgacgtaccaacggactacgtanagttcgtattcgtaacgttcttaagtactacgaataacgttataacgtaacgttacttaagtaccgttacgttaccgtaccggtatacccggttaagtcgtacgtaagtcctaaagaacgttacgnggtacagtcggaactctaactgttcctattac

SEQ ID NO: 167740 - DNA, 607 bp, Homo sapiens
  misc_feature: GYAE6OF02JIWDJ.16.81.H04.1.454.CMB.1.raw
  modified_base (96)..(96): a, c, t, g, unknown or other
  misc_feature (96)..(96): n is a, c, g, or t
tcagtgtactactccacgaccggtgctcgatttagtagtgtagattcgcgggggtcagactcagtcaggacacagcatggacatgagggtccccgntcagctcctggggctcctgctgctctggctcccaggtatcaaatgtgacatccagatgacccagtctccttccaccctgtctgcatctgtcgagactacgatccaccatcacttcggccgggccagtcagtacgttgttaggtacctgggttcgccgttggtacttcagcgaacgaaaccgagggaaaccgccctaaggcctccgtgatcctatgatcgtctacaatacgaggaagtcgggtaccatacgaagttcacggcgtcgagtcggactcgacggactaagattcacgttctaccgacacgtcgtacgacgacgcctacacgtacctgtacgtcgtacttttgacgttacttattattacgacctaagacgtaagtaagtacgtttaacgttactaccgtttaccggcccgtagtaaccgttagtacggttagacttaacgtaaccctaaagtaaccgttaggacgttacgtacgtaccgaccttacgtcgttcgttacttacccg

SEQ ID NO: 167741 - DNA, 735 bp, Homo sapiens
  misc_feature: GYAE6OF02IE04X.16.81.H04.1.454.CMB.1.raw
  modified_base (189)..(189): a, c, t, g, unknown or other
  misc_feature (189)..(189): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgcatttgcgganacagagtcacatcacttgccggcagtcagagtgttggacctggttcggcctaggtactcgtacgacaaggtaaaccgaagggaaacgccccgttaaagccttacctaggattcctagtacgtattcgtacctacctaatagtacggaaacggttcgggaccctagtacgtaaggttcaggcggctaggtcggagtcgtaggaacaagtactttaccaacgttccttacgaaccctagttaccaacggtacctaaccggaccccgttaacgaaccggttacccgttaggtaaccgttaggtaaccgttttttcggaaccgtttaaaccgttttaacgtttaacgttccgtaaacccgtaaataaacggttaattaaacgggttaacgtttacttaaccgttaaccgtttccgggacccgttaacgggtaacctaaacgtaggttacggtaacttaacgttaacccgtaaaaccgggtaacgttacggtaccggtaccgtacgacccgtacgttaaccgttactttaccgttaccgttcttaacccgg

SEQ ID NO: 167742 - DNA, 586 bp, Homo sapiens
  misc_feature: GYAE6OF02FKO3Y.16.81.H04.1.454.CMB.1.raw
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
tcagtgtactactccacgaccggtgctcgattagtagtgtagattcgcggggtcagactcagtcaggacacagcatggacatgagggtccccgctcagctcctggggctcctgctgctctggctcccaggtatcaaatgtgacatccagatgacccagtctccttccaccctgtctgcatcctgtcggagacagagtcaccatcacttgccgggccagtcagagtgttggtacctgggttggcctggatcagcagaacccagggaaacncccctaagcctcctgatctatgatgtctacaatngaaagtcggtccatcaaggttcagcgnagtggatcgtggacagaactttcactctaccacatcagcacgcctacagtcctaggtatcgtaattttcggacctactttaacttacttacggaccctaacgtaaggtttaactaaaggtaacgttttaacttaccgttaaacccgttttccgggacccctttaggggaaccctaagttcgttaggacttaacgtaaccgtaaaccgaacttggtcggtacttacggcctaacctataccttggttcctttacccg

SEQ ID NO: 167743 - DNA, 723 bp, Homo sapiens
  misc_feature: GYAE6OF02HGIEC.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccacctgtctgcatctggtcggagacagagtcaaccatctacttcggccggaccagtcaagtagttgttcggtaccgttgggttcggcctggtatcagacaacgaaaccgaggaaacgccccgtaagctacctgactctatgatcgtcctacaatagtaggtaaacggtcgggtaccagtacgtaaggttcaggcggacgagtaggagtcgtagggaacaagtacttcactcctacaaccatacgagcacggtacctacgacgtccgtagtaacttacgttaacttttcggaaccgtttaacttttaagttttaacgttaaccgtaacccttaaaactaggtttaaaacgttaaaacgttaaacgttttaaccgttttaaaccgttaaacccggttttacccgggtaaccccggtttaaccgggtaaaccgttaaggtttacggtaacggttaacttaaacgttaaacccggtaaaacggttacgttacgggtacggtaccgtacgtaaccgtacccgttacgttaccggtttacgtttaccgttacccttacccg

SEQ ID NO: 167744 - DNA, 720 bp, Homo sapiens
  misc_feature: GYAE6OF02J2NI0.16.81.H04.1.454.CMB.1.raw
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagtgtactactccacgaccggtgctcgattagtagtgtagattcgcgggggtcggacgtcagtcaggacacagcatggacatgagggtccccgctcagctcctggggctctgctgctctggctccaggtatcaatgtgacatccagatgacccagtcctccttccaccctgtctgactatcgtgtcggagacagactcaccatccacgttcggccgggccagtacaggcgttgttcggtcgtggttcgccgtggtatcgacgcgaacggaaaccgacgggaaaccgtaccccgtaaacggccttccgtagtaactctagtcgtaatcggtacctaccaagttaagtacgggtaaacggtcgggtaccactacggtaacggtcacggcggtgtagtcgtagtcgtagggactaggtactcgacttccncaactnacgtagccagtaccctagcgtaccttagacgttgttacgtttcggactttaaaccggtttattaaccgttcgaaaccctaagtaacggttaaacgtaaggttaccgtttaccttaaccgttaaacccggtttccggttacccgaacccggttaagtaacgttcgggtaagtacccgttaagttaaccccggtaaacgggttaaccttcggtaacgggttacctacgggttaacccctaacgtttaaccgggttccctaaggttttccccttaacgtttacccccg

SEQ ID NO: 167745 - DNA, 688 bp, Homo sapiens
  misc_feature: GYAE6OF02JF4KL.16.81.H04.1.454.CMB.1.raw
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
tcagtgtactactccacgaccggtgctcgatttagtagtgtagattcgcgggggtcagactcagtcaggacacagcatggacatgagggtccccgctcagctcctggggctcctgctgctctgactcccaggtatcaaatgtcacactccagactcgaaccctgtcctccttcccgacccgtcgtctcgcagttctgtcgagacaggactcacatctacttcgccgggtcagtcgagtagttcgttacggtaccgtggttcgaccgtggtatcgacacgaanaaccggagaaaccgaccctaagctaccgtanacttacgatagtacgttcgacctacgtaagtaggtacgggtaaacggcgggtccctaagttacgtaacggttcgaagggccggtaagtacggacggtacgttcggagtaccgtagtaactctaccgtacgtacaccgtagtacgaccgactccggtactacgtggtaccttgtacgttagtacgtttagtacgttactttagtaccttcgaaccttaagttacggttaactaaagggttaccttaacgtttaccgtaacccggtttccggtaaaccggttacaacccggtttagtacggtagttaacgtacgtttaaacgaacgtagtacgtcgttaacgcggttaacctcgttaacgtccttagttcttaaccg

SEQ ID NO: 167746 - DNA, 785 bp, Homo sapiens
  misc_feature: GYAE6OF02HGRXT.16.81.H04.1.454.CMB.1.raw
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatcgaccagtctccttccaccctgtctgcatctgtcggagacagatcacatcacttcgccggcagtcagagttgttggtacgtggttcggcctggtatcgagcaagaaaccgaagggtaaaccgacccgtaacgtctaccgtagtactctagtgagttcgtacctacctaagttaggtaacgggtaaaggttccgggtacctaacgttacggtaacggttacgacgggacggacgtaagggttaggacgttcggtagggaactaacgtaacttaccgtaaccttcctacctaactacctaccgaacgtacccaactacccgtacggtacgttaccgtagttacgttacggttttacgtttcggtaaccggtttaacttttaacgttacgttaccgtaaacctaacgttaaacggtttaaacgtttaaacggtttaactttaccggttttaacccgttaaacccggttttcccgggggtaacccgggtttaaaccggaaaccgttaagttccgggttaacgttaaacgtttaaccggtaaaacccgttaaaaccggttaccggtagggttaacccgagttaacccggtaacccgttaacctaaccggttttcttacccggttttaccttacccg

SEQ ID NO: 167747 - DNA, 748 bp, Homo sapiens
  misc_feature: GYAE6OF02IZOEL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccacctgtctgcatctgtcggagacagagtcaccatcacttcgccggcagtcagagtgttggtactggttcgcttggtatcagacaagaaaccgaggaacgccccgtaagcctctagatctatgattcgtctacctaatagtagggtaacggtcgggtaccctagtacgtaacggttcgaacggtcggacgtaaggtcggtacgttacggtacgggtaacctaaagtaaactttccgaaccttaccgtaacccgtaaacctacgtacgaaaccgtaccgaaccgtaacccgtaacgtaaccgtccgtacggtaagtttaggttaaaccttttttccgggaactttaaacggttttaactttttaacgtacggtaaaccccttaaaacgtaacgtttaaaagttaaaccggtttaacgttttaacgtttaaccgtttaaccggtttacccgggtaaccccgtacggttaaaaccttaagttggtaacggttaacttaaacggtaaacgtaaaaccggtcgttaacggttacgtaccgttacgaacccttacgtaacgttccgtttacggttacctttacccg

SEQ ID NO: 167748 - DNA, 581 bp, Homo sapiens
  misc_feature: GYAE6OF02ITK0L.16.81.H04.1.454.CMB.1.raw
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagtgttggtacctggttgcctggtatcagcagaaaccagggaaacgcccctaagcctcctgatctatgatcgtcnccaatagtaggaaagtgggtcccagtacgaaggttcaggcgacnggtgatcgtggacagtaactcactcacacatcagacacgacctacgcgtcctgattagtatttcgactaactttacttattcgacctaaacgtagttaaataagttagtttaacttaccgttaacgttttccggacccgttagggaaccctaagttcggtagtaacgttacgtaacgtaaaccggtaagtcggttacgggtcttacggacctacctagtttaccgttacgttccgttacc

SEQ ID NO: 167749 - DNA, 719 bp, Homo sapiens
  misc_feature: GYAE6OF02HH5Y6.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgaccagtctccttccaccctgtctgcatctgtcggagacagagtcaccatcacttcggccggcagtcagagtgttggtacctggttcgcgtgtatcagcaagaaaccgaggaaacgacccctaagcctctgatctatgatcgtactacctaatagtaggtaaacggtcgggtacccaagtacgtaacggttcgacggtcggacgtaggtacggtagtacggtacgggaacgtaagtaacttaccgaccttctacctacctaatcgaacgacaacgtaccctaacgacgtacctagggtacttacggttattttacggaaccgtttaactttacgtttaactttacggaaaccctaaagttaacggttaaatttaaacggttaacgttttaaacctttaccgtttaaacccgttttcccgggtaaccccggttaagggtaacccctaaagggtttaccggtaaggttaacttaacggtaaacccgtaaaaccggttaacgttacgggtacggttaccgtaacgtacctaaacccgttgtttacccgttagtttacccggttaaccc

SEQ ID NO: 167750 - DNA, 591 bp, Homo sapiens
  misc_feature: GYAE6OF02GZIPL.16.81.H04.1.454.CMB.1.raw
  modified_base (149)..(149): a, c, t, g, unknown or other
  misc_feature (149)..(149): n is a, c, g, or t
  modified_base (284)..(284): a, c, t, g, unknown or other
  misc_feature (284)..(284): n is a, c, g, or t
tcagtgtactactccacgaccggtgctcgatttagtagtgtagattcgcgggggtcgaggactcagtcaggacacagcgtagtggacatgagggtccccgcctcagctccgtggggctcctgctgctctggctccaggtatcaaatgtnacatccagatgacccagtcctccttccaccctgtctgcatctgtcggagacagagtcacatcacgttcgccgggcagtcagagttgttcggtacctgggttgccttggtatcgagcaagaaaccgaagggaaacncccctaagctctgatctatgatcgtctactaatagtaggtaacggtcgggtaccagtacgtaacggttcacggcggcgtaggtggatcggtagggactagtaactcactctacacatcagcacgtcctacgacgtcctgtacttgtacttttcgacgtttatttagttactacgacctaagtaagttaattaagttactttacttacgttaaccgttccggtacccgtaggtaacctagtgtacgaattaacgtaacgtaaacgtacgtcgtacgcgtacgtacctactcgtttcgttactcttacg

SEQ ID NO: 167751 - DNA, 777 bp, Homo sapiens
  misc_feature: GYAE6OF02JL1SS.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctccctgctgctctggctcccaggtatcaaatgtgacatccagatcgacccagtctccttccaccctgtctgcatctgtcgagacagagtcaccatcacttcggccggccagtcagagtgttcggtacctggttcggcctggtactcgagcgaacgaaaccgagggaaaccgtaccccgtaagtccgtacctggtactctagtcgtatcgtacctacctaagttacgtagggtaaacggtcggggtaccctagtaccggtaaggttccgaacggccggactaaggtcggtatccggtagggtaactaacggtaacttacccgtacttcccgtaccgaacctactaccgtaacgaccgtaaccgtaacccgttacgaccggttaccacggtaacgtttacgttaacgttttacggtaacccgtttaacctttaacgtttacgtttaaccgtaacccctaaaaggtttaacgttaacggtttaaagtttaacggtttaacttttaacccggttaacgttttacccggggtacccgttacgggtaaacccttacgggttaggtacggttaacggtaacccgtaaccggtttaaaacggtacggttagggtacccgttaacggttaccgtaaccctaacccggttactttacggttaccgtttacccgtacg

SEQ ID NO: 167752 - DNA, 650 bp, Homo sapiens
  misc_feature: GYAE6OF02GZ0XT.16.81.H04.1.454.CMB.1.raw
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (444)..(444): a, c, t, g, unknown or other
  misc_feature (444)..(444): n is a, c, g, or t
tcagtgtactactccacgaccggtgctcgatttagtagtgtagattcgcgggggtcagactcagtcaggacacagcatggacatgagggtcccgctcagctcctggggctcctgctgctctggctcccaggtatcaaatgtgacatccagatgacccagtctccttccaccctgtctgcatctgtcgagacaggacgtcaccatcacttcgccggcacgtcagagtgttggtacctggttgcctggtatcgagcaagaacgaggtaacgccctaagcctccaggtactctatgactgtccgtacagtagtagggtaacggtcgggtacctagtacgtacggtcgagtcgggcgtaggtggaaccgtgacggganaacgtaactacgactccgtacaccgtntacgaacnccgtaacgcctaacgacgtctacgaagttacgttntttacgggtacttaccttttaagttacgtacgtaacccgaaagttagttaaacggtaaagtttacgttttaaccttacgtttaacccggtttacggtacccgtacggtaaaccgtagttccggttagaaacgtttaccgtaaacaaccggttaaacttgggacggttactacggtaccgtcctaacggttcttacggttacttccg

SEQ ID NO: 167753 - DNA, 618 bp, Homo sapiens
  misc_feature: GYAE6OF02GHFR7.16.81.H04.1.454.CMB.1.raw
tcagtgtactactccacgaccggtgctcgatttagtagtgtagattcgcgggggtcagactcagtcaggacacagcatggacatgagggtccccactcagctcctggggctcctgctgctctggctcccaggtatcaaatgtgacatccagatgacccagtctccttccaccctgtctgcatctgtcggagacagacgtcaccatcacgttcggcccgggccagtcagtagtgttcggtacctgggttcggccgttggtatacagcgaacgaaaaccgagggaaaccgcccctaaggcctacctgatctatgatcgtccacaatagtaggtaacgtcgggtaccagtacgtaaggttcacggcggacgaggtggtacgtacgtagggacaagtacttacaccgttcgtaccacctagtaccgacggtcaacgccctaacgtcgaccgttaggacttagttagtttcgaaccgttatttattacgtacgacctaagtagttaataagttagttacttacgtaacgtttccgggacccgttaggaacctagtggtagtattaacgtaacaacgttacgtggtacgtacgttcacgtacctagtttcttacgtccttaccg

SEQ ID NO: 167754 - DNA, 627 bp, Homo sapiens
  misc_feature: GYAE6OF02FLMQU.16.81.H04.1.454.CMB.1.raw
  modified_base (333)..(333): a, c, t, g, unknown or other
  misc_feature (333)..(333): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccggcagtcagagtgttggtacctggttggcctggtatcagcagaaaccagggaaacgcccctaagcctcctgatctatgatgtctcaatagtaggaaagtgggtcccatcaaggttcagcggnagtggatcgtggacagaattcactccacacactcagcacgacctaacgacgtccgtagattacgtagttttacggacgttacttttaagtttacgttaccgtaacctaaacgttaagttaaagtaaggttagttttaacttaaccgtttaaccgttttcccggtaacccggttacgggaaccgtaacgtttagggtacggtaattaaccgtaaacgtaaaacccgttaacgttagggtaccggtaccgttacgtacccgaaccgttacttaccgtttaccgtttccgtttaacc

SEQ ID NO: 167755 - DNA, 708 bp, Homo sapiens
  misc_feature: GYAE6OF02FGWSE.16.81.H04.1.454.CMB.1.raw
  modified_base (223)..(223): a, c, t, g, unknown or other
  misc_feature (223)..(223): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (549)..(549): a, c, t, g, unknown or other
  misc_feature (549)..(549): n is a, c, g, or t
  modified_base (672)..(672): a, c, t, g, unknown or other
  misc_feature (672)..(672): n is a, c, g, or t
tcagtgtactactccacgaccggtgctcgatttagtagtgtagattcgcgggggtcagactcagtcaggacacagcatggacatgacggtcccgctcagctccgtggggctcctgctgctctcggctcccaggtatcaaatgtcgacactccgagactcgacccattcctccttccgaccctgtctgctactcgtcgacggacacgtacggtactaccaaccncgttcaccgttcggcccgggacctaacgcgacggttacggttcggtttaccggtaccgttcgggtttccggacttacggttacacgaacgaccgaaccggaaaaccggttaacggaacccgtaccccgttaanccttccaggtactacggtancgtactcgtcaactagtagacggtacggtcgcctaagtcgtacgttcgacgtggtagacgtcggtacgcgtaacggtatacgtactacncctaccggacacncaccgggnaccgttacaccgacgtcgacgttagtccgttattacggttacttacttattacgggttaaccncgtaaaccgattaaggttaactaggttaacttaccgtaacttaccggtaccgacgtacggttaacgacggtttacacgttaacaccgttaaaccggtgaccggtcgttaccgacgttaacccncgggttaccttacgtcctactttcccttaaccgggg

SEQ ID NO: 167756 - DNA, 539 bp, Homo sapiens
  misc_feature: GYAE6OF02FGVLM.16.81.H04.1.454.CMB.1.raw
  modified_base (345)..(345): a, c, t, g, unknown or other
  misc_feature (345)..(345): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagcctcctgatctatgatgtctcaatagtaggaagtgggtcccatcaaggttcagcggcaggtgatcgnggacagtaattcactctacacatcagcacgccacgagcctgactgtatttgactactttaattagttcgaccaaatacgtaataagttagttaactttacgtaacgttttccggacccttacgggaacctaagtcgtagaacttacgtacgaaacgacttggcgtacgtacgcctaacctntcgttntccttcg

SEQ ID NO: 167757 - DNA, 743 bp, Homo sapiens
  misc_feature: GYAE6OF02J0001.16.81.H04.1.454.CMB.1.raw
  modified_base (293)..(293): a, c, t, g, unknown or other
  misc_feature (293)..(293): n is a, c, g, or t
tcagtgtactactccacgaccggtgctcgatttagtagtgtagattcgcgggggtcagactcagtcaggaaaaaaaacacagcatggacatgagggtccccgctcagctcctggggctcctgctgctctggctcccaggtatcaaatgtgacatccagatgacccagtctccttccaccctgtctgcatctgtcggagacagacgtcaccatcacgttcggcccgggccagtcagtaggtgttcggtaccgtgggttcggccttggtatcagcaacgaaaccgaagggaaacncccctaagcctcctagatcgtatcgatcggtacctaccaagtacgtagggtaaacggtcggggtaccctagtacgtaacggttcgacggtccggactaggtaggtactcggtagggaactaagtaacgttccacttaccgtacctaacgtactaccgaacggtcctaagtaaccccgtaccgtagtccctaggtacgttacggttacgtttacggaccgtttaacgttttatttaacgttaccgtaaccctaaagttaaacggttaacgttaaacggttacggttttaaaccttaaccgttaacccggttttcccggtaacccgttacgggtaaaccgttaagttacgggttaacgtaagttaacgtaaccgtaaaaccggtacgttacggttaccggaccgttacggtaccctaaacccgttgttaccgttccggttacccttacccgg

SEQ ID NO: 167758 - DNA, 799 bp, Homo sapiens
  misc_feature: GYAE6OF02IL4R4.16.81.H04.1.454.CMB.1.raw
  modified_base (97)..(97): a, c, t, g, unknown or other
  misc_feature (97)..(97): n is a, c, g, or t
tcagtgtactactccacgaccggtgctcgattttagtagtgtagattcgcgggggtcagactcagtcaggacacagcatggacatgagggtccccgntcagctcctggggctcctgctgctctggctccaggtatcaaatgtgacatccagatcgacccagtcttccttccaaccctgtactgctatcgtcgtcggagtacagacgtaccaccatctacgttcggcccgggactagtcaaggtacgttcggtttacggtacccgttggttcggaccctttaggtattaccggacgaccgtaaacggaaaaccggaaacggggaaacctacccctaagtcctccgtagtacttcttagtacgtactcgtaaccaaactaaggttagtaacggaagggttccggtaaccagtacggtaaggttcacggtcgcgtaaggtggtaccgtcgtacggaataacgttaagtaccccttaacgtccaacgaacccgtactaacacggtacctaaccgtacccgtaactacgtacgtactacggtttactttaacgtttcggaacgttttacttaacgtttactaaaccgtaactaacgttaaacgtaaccggtttaaagtttaacctttaaccgttaactttaaccccggttaagggttccccggttaaaaggttaaaccccgtttataaccggggttactaaaacgtttcccggtaaaaccgtaaccggttaacggttaccgggacctacggttaacccgtaacctaccgtttacgtaccccggtttacttacccgtttaacccg

SEQ ID NO: 167759 - DNA, 514 bp, Homo sapiens
  misc_feature: GYAE6OF02IHA79.16.81.H04.1.454.CMB.1.raw
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctcctttccaccctgtctgcatctgtcggagacagagtcaccatcacttgccgggccagtcagtagtgttggtacctggttgcctggtatcagcagaaaccagggaaagcccctaagctcctgatctatgatgtctccaatatggaaagtggggccatcgaaggttcagcggcagtgatcnggacagaattcacttcncacctatcagcagcctanagctgatgtattttgcgtaactttattattgacctaaanaagtaataaagtagtttatacttaacgttcgaccctgggaaccaagtgtaggatatacaaacgtaactggtacgctagcactagtctgtccttatacg

SEQ ID NO: 167760 - DNA, 517 bp, Homo sapiens
  misc_feature: GYAE6OF02HLCMN.16.81.H04.1.454.CMB.1.raw
  modified_base (332)..(332): a, c, t, g, unknown or other
  misc_feature (332)..(332): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (470)..(470): a, c, t, g, unknown or other
  misc_feature (470)..(470): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggcagtcagagtgttggtacctggttcggcctggtatcagcagaacaggaagccctaagctcctagatctatgatgtctacaatataggaaagtcgggtacccatacaaggttcagcggnagtggatcgtggacagacttcactctacacatcgagcaanccctaancgcctagtactgtatttgacgtacttattactacgactaacagttaataagtattattactaacgttcgccgtagaactagtgtagattanacgtaaacgacgtacgtgtactcgacgacctagtcttgtacttaccg

SEQ ID NO: 167761 - DNA, 607 bp, Homo sapiens
  misc_feature: GYAE6OF02FNUHP.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacgttggccgggccagtcagagtgttgggtacctgggttggcctggtatcagacagaaaccgaagggaaacgaccccgtaagcctccgtagatctatagtagtcgtctactaatagtagggtaaacggtcgggtaccagtaccgtaaggtacgagcggcgagtggatcgtaggacagtactcactcacacatcagcacgctacgacgtcctagtacttgtagtttacgacgttactttaagttacttagtacctaaactaagttaataaagttacgtttaactttaccgttaaccggtttacccggtaccgtacgggtaaccttaagtacggtagtactacggtaacgtaaacgtacgtacggtcgtacgtacgtaccaccttagtcgttacgtcctttacg

SEQ ID NO: 167762 - DNA, 499 bp, Homo sapiens
  misc_feature: GYAE6OF02GTQMB.16.81.H04.1.454.CMB.1.raw
  modified_base (359)..(359): a, c, t, g, unknown or other
  misc_feature (359)..(359): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaaagctcctgatcatgatgtctccaatatggaaagtggggtacccatcaaggttcagcggcagtgatcgtggcagattcactcncaccatcagcagcctaacagcctgatgtatttgcgactttattatgccaaangtaanaagattattctaactttcgccctaggacctaagtgtagntagtcaaacgtactagtcggctagcacgtactctagtcttaccg

SEQ ID NO: 167763 - DNA, 746 bp, Homo sapiens
  misc_feature: GYAE6OF02H9DOF.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaatgtgacatccagatgacccagtcctccttccaccctgtctgcatctgtacggagacagacgtcaccatctacgttcggcccgggcagtacaggtagttggttaggtaccgttgggttcggtccgttagggtaactcgaacgacgaaacggaaaaccgaacggggtaaaaccgtacccccgtaaaggtcccttaccgtaggtaacttaccgttaagtacggtaacttcggttacctaccgtaaaaggtaacggttaaggggtaaacggttccgggtaccctaagtaccgttaacggttacgacggaccgtagtaagggtacggtaattcggtaacggacgtacggtaaaaccttcctaccgtaccgtaactaaccgtacttacggacgaaccgtaccgtacccttaacgacggtccttagtaattaggtttattcgtaaccgtttaactttgtttaccactacgtaaacgttaagttaagttaaacgttacgtttaacgtttacgtaaccgtttccggaccgttaaccggaacgttagtcgtagttaatacgtaaacgaacgttacgtggtccagtaccgacctaacgttcgttacgtcttacgttacc

SEQ ID NO: 167764 - DNA, 729 bp, Homo sapiens
  misc_feature: GYAE6OF02F9DYG.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctccaggtatcaaatgtgacatccagatcgaccctagtcctcccttccacctgtctgcatctggtcgagacagagtccacgatcacgttcggccggccagtcaggtcgtgttcggtaccgttgggtcggccgttaggtactcgacggcgtaaacggaaaaccgaacggggaaacctaccccgtaagtccttaccgtagtaacttacttaacgtcgtagttcgttacctacgtaaagttacggtacgggtaaggttcggggtaccctagttacgtaacggttacgacggtcggtacgtaggtacggtacgtcggtaggtaacgtaaagtacgttctacctaccgtaccgtaactactacgacgtaccaaccgtaccgtacgtacgtaccgtagtaacttacgttagtttaccgtacgttaactttacgttacttacgaacgtaaagtaagttaaacgttaaggtactttacgttacgttaaccggtttcccggaaccgttacggtacttaagttgtacgtaacgtaacgtaacgtaaacgtacggttcggtaacggttaccgacgtaccgtaccgttacgttaccgttctttaccgttcttacccg

SEQ ID NO: 167765 - DNA, 644 bp, Homo sapiens
  misc_feature: GYAE6OF02GK4SP.16.81.H04.1.454.CMB.1.raw
  modified_base (276)..(276): a, c, t, g, unknown or other
  misc_feature (276)..(276): n is a, c, g, or t
  modified_base (370)..(370): a, c, t, g, unknown or other
  misc_feature (370)..(370): n is a, c, g, or t
  modified_base (429)..(429): a, c, t, g, unknown or other
  misc_feature (429)..(429): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccgggcagtcagagttgttcggtacctgggttgcctggtatcgagcaagaaaccgagggaaacnccccgtaaagcctccagtactctagtcgatcggtactacctaatagtaggaaacgggtcggggtaccctaagtccgaaaggttcgaggacgggnaggtcggagtcgtagggacaaggtacttacacgtctacactatcacgcacgtcctaacngtaccgtgtaagttacttagttttcggcgttaacttttagtttactcgtaacccaaagtaagttaagtaagttaacgtttacttaaccgtaaccgttttccggtacccgttacgggtaaactaagttggtagtacttaacggtaaccgtaaaacgtacgttcggtacggtacgtacgtaaccgtaccctagttacccttacggttacttaacccg

SEQ ID NO: 167766 - DNA, 643 bp, Homo sapiens
  misc_feature: GYAE6OF02HCLHW.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctggtcggagacagagtcaccatcacttcgccggccagtcagtagtgttcggtacctggttcggcctggtatcagacaacgaaaccgaggaaacgcccctaagcctctgatcgtagtgattcgtctacaagtagtaggaaacggtcgggtaccagttacgtaaggttcacggtcggacgtaggtagtacgtcgtagggaactaacgtaacttccgaacctcctacaacctatccgagacctacgccctaagccgtactagtatagttacgtttcgaccgttaacttttacgtattaccgacctaagtaacgtaagttaacgtacgtttacttaccgttaaccgttttccgggaccgttacggaaacttacggtagttacggtaacttacggaaaccgtaaacggttaacgtggttaccggaaccttacgaccttaaccgtagtccgtttcgtacccttccg

SEQ ID NO: 167767 - DNA, 634 bp, Homo sapiens
  misc_feature: GYAE6OF02FIZ1O.16.81.H04.1.454.CMB.1.raw
  modified_base (310)..(310): a, c, t, g, unknown or other
  misc_feature (310)..(310): n is a, c, g, or t
  modified_base (367)..(367): a, c, t, g, unknown or other
  misc_feature (367)..(367): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctccccaggtatcaaatgtgacatccagatgacccagtctccttccaccctgtctgcatctgtcggagacagagtcaccatcacttgcccgggcagtcagagtgttggtaccttggttggcctggtatcgagcagaaaccagggaaacgcccctaagctcctgatctatgatgtcctaccaattanacggtaaagtcggggtacccagtacaacgggtttcaaggtccggcaggtggactcgngggacagtaatttcactcctccaccactactagcacgcctacgacgtcctacgtatagtagttttcgacgttactttaatttacttacgtaccctaacgtacgttaaagtaaggttaagtttaactttaaccgttaacgttttaccgggacccgtttaacgggaacccttaaggttacggtacggtaactaccgtaaaccgtaaaccgtaacgttggttaccggacgttaccgactaacccgtacttaccgttcgttacgtttaccg

SEQ ID NO: 167768 - DNA, 850 bp, Homo sapiens
  misc_feature: GYAE6OF02GYAY5.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcggccgggccagtcagagttgttggtacctgggttcggcctggtatcgagcaagaaaccgagggaaacgcccctaagctcctgactctatgtatcgtactaccaatagtagggaaaaggttcggggtaccctaagtaccgtaaggttacgacggtccgggtacgtagggttacgggtaacgtttaccggtacggggtaaacgtaacggtaaactttcccgtaacccttaccgtaacccgtaaccctaaccggttaccgaaccgggtacccgaaacccggtaacccctaaacccggtaccggtaccccgtttaaggtaacgtttacggtttaacggttttttaccgggaaccgttttaaacgttttttaaacgtttaaaccgtttacccgtaaaccccgtaaacgtttaaggttaaaacgtttaaacgggtttaactttttaaacccggtttaacccgtttaaccccgggtttttacccgggtaccccggttaaacggggtaaaccccttaaaggtttcgggtaaggtaactttaaaccggttaaacccggtaaaccggttaaccggttcgggtaccggttaacgtcccggtaccctaaacccggtttacttacccggttttacggttacccgttttaaccc

SEQ ID NO: 167769 - DNA, 501 bp, Homo sapiens
  misc_feature: GYAE6OF02F2GVK.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttgcctggtatcagcaagaaaccagggaaacgcccctaagctcctgatctatgatgtctcaatataggaaagtcgggtccagtcaaggttcagcggcaggtgatcgtgggaacagtaattcactctaccactatcagcacgcctacagcctgatgtattttgcgtatttattatgaccaagtagtataagtattattactaacgttcgcctggaccagtgtagatagtacaacgtagtgtgctagctactatcgtagtctacg

SEQ ID NO: 167770 - DNA, 572 bp, Homo sapiens
  misc_feature: GYAE6OF02F30GJ.16.81.H04.1.454.CMB.1.raw
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccggccagtcagagtgttggtacctgggttcggcctggtatcagcaagaaaccagggaaagcccctaagcctccngatctatgatgtcncaatanagaagtgggtccatctaaggttcagcggcaggtgatcgngggacagtaattcaactctacacctatcagcacgactacacgcctgtaattgtagttttagacgtacttatttacttgacctaaactagttaagtaagtaagttttaacttacctaaccgttttccggaccccgttagggtaacctaagttgttacgggaactaagtacgtaaaccgtaacgtaggttacggacgttacgactaccgtaacttcgttcgttacttaccg

SEQ ID NO: 167771 - DNA, 651 bp, Homo sapiens
  misc_feature: GYAE6OF02IHRCC.16.81.H04.1.454.CMB.1.raw
  modified_base (347)..(347): a, c, t, g, unknown or other
  misc_feature (347)..(347): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctccaggtatcaaatgtgacatccagatgacccagtctccttccaccctgtctgcatctgtcggagacagagtcaccatcacttggccggcaagtcagtagtgttggtacctggttgcctggtatcagcagaaaccgaggaaacgccctaagctctgatctatgatgtctccaatagtaggtaagtcggggtaccagtcaaggttcaggcggctagtggatgnggacaaggtacttcgactctacacctatcacgcaacgcccgtacacgtccgtagacgttgttagttttacgaccgttaacttttattaacgttacgtaacccgaaataaacggttaattaaaggttaactttacgtttaccgttaaccgttttcccggggtaaccccgtacggggtaaaccctaaggttacggtaaggtacttaacgttaacgtaaaaccggttaacgttacgggtacggttaccgtaaccgggtacctaaccgttaccttacccggttacggtttccccttacgttaaccccg

SEQ ID NO: 167772 - DNA, 523 bp, Homo sapiens
  misc_feature: GYAE6OF02G3M2I.16.81.H04.1.454.CMB.1.raw
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (417)..(417): a, c, t, g, unknown or other
  misc_feature (417)..(417): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttgtacctggtgcctggtatcagcagaaaccagggaaacgcccctaagctcctgatctatgatgtctccaatatggaaagtgggtccagtcaaggttcagcggacagtgatcgngganagtaattcactctacacatcagcagcctacgcgctgattgtatttgacgttactttattagttcgacctaanagttaataaggtatttacttacctaacgtttccggacccgtaggaacctaagtgtacgtatagtaacaaacgtataggtagatagccacctatcttagttcttacg

SEQ ID NO: 167773 - DNA, 643 bp, Homo sapiens
  misc_feature: GYAE6OF02HSJIY.16.81.H04.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (244)..(244): a, c, t, g, unknown or other
  misc_feature (244)..(244): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtctccttccacctgtctgcatctgtacganacagngtcaccatcacttgccggcagtcagtagtgttgacctggtcgctgtancagacaacgaaacaggaacaccctaagctacctgaattctattgatcgtctacaagtagtaggaagtgggtcccaagtctaagtcgaagcgacagtaggatacgaggacaagtaacttcaacgttccacaaccctagtacgacacgtaccggtaccctaacgacgaccgtagtagtacgttaagtttcgaacgtttaactttaagttaccgtacgtaaccaaaccgtagttaaattaaacggtagttttaacgttacgttaaaaccgttttcccgggaccggtaacggtaaccgttaagttcggacgttaactaacgtaaccgtaaaaccggtagttaacgggttcggaaccttaccggactaaacccgttagtaacccgtttacgttaccctttaccg

SEQ ID NO: 167774 - DNA, 731 bp, Homo sapiens
  misc_feature: GYAE6OF02IRKDS.16.81.H04.1.454.CMB.1.raw
  modified_base (229)..(229): a, c, t, g, unknown or other
  misc_feature (229)..(229): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaaatgtgacatccagatgacccagtctccttccaccctgtctgcatctgtcggagacagacgtcaccatcacgttcgcccgggcagtcaggngttgttggtaccttggttcggccttggtactcgagcgaaacgaaaccgagggaaacgtacccctaaaggcctaccgtgacttactaagtgacttgtacttaccgaagttaacgtagggaaaggttcgggtacctagtaccgtaaacggttacgaacggtccgggacgtaagggtacggagttcggtaagggaacaacgttaacttccgtaaccttccgtacgaacctactaccgtaacggacctaaccgtccgtaaacgacgtaccgttagtaacttacgggttaagttttacgtaccggttaacttttaacttaagttaccgtaacctaaacgttaagttaaagtaaacggttaagttttaacgttaccgttaaccggttttaccggtcccggttaaacggtaccttaagttacggttagtaattaaccgtaaacggtaaaccgtaaggttcgtacggtacctacgacctaccgtaacgtttccgttagttactttacccg

SEQ ID NO: 167775 - DNA, 783 bp, Homo sapiens
  misc_feature: GYAE6OF02HSBC7.16.81.H04.1.454.CMB.1.raw
  modified_base (151)..(151): a, c, t, g, unknown or other
  misc_feature (151)..(151): n is a, c, g, or t
  modified_base (193)..(193): a, c, t, g, unknown or other
  misc_feature (193)..(193): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtgacatccagntcgaccagtctccttccacctgtctgctatcgtggtcggaanacgagacgtcacctatctaccgttggcccggcagtcgagtaggttggttacgtaccgttggttcggccgttggtactcgaggaccaaaggaaaaccgtacggggaaacctacccccgtaaaggtacccttacccgtaggtaacttaccgttaattcgggttaacgtacggtttaccttaacccctaaagttaacggttaaagggggtaaaacgggtttcccggggtaccctaacgttaaccggtaaacgggtttacgaacggtaccggggtactaagggtacggtaacgtttacgggtacggggtaaacgaattaaccttccgtaacttaccgtaccaaccttactaccgtacgacgtaaccgtcccgtacaccggtctaagttagtgtttactttcggtaaccgttattactttacggtacaaccgttaaagaacggtttaaattaacggtacgttttaaccttaccgttaaccgggttttccgtaacccggtaggtaaacccttaaggcggttaaggttacctaacggtaacaaaccgttagtaggtaccgcgtaaccggcttaccgactttcgtcgttcttaacccg

SEQ ID NO: 167776 - DNA, 646 bp, Homo sapiens
  misc_feature: GYAE6OF02GHOZK.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcggccggccagtcagagttgttggtaccgtggttcggccttggtatcagcgaagaaaccgaagggaaacacccctaagcctcctgatctatgattcgtctacaattagtaggtaaacggtcgggtacccagtacgtaaggttcaggtcggacgaggtgtagtcgtagggaactagtacttacacttcgtaccacactcagacacgcctacacgtcctagtattgttattttcggacgtttaactttatttacgttcgtaacctaaacgttagttaaacttaaggttaagtttaactttaccgttaaccgttttcccgggtacccgtaacgggtaacttaagttggtaacggttactaacgtaacgtaaacggtacgttcgggttacgtaccgtacggtaccctacccgttaagttccgttacgtttacccgttaccg

SEQ ID NO: 167777 - DNA, 557 bp, Homo sapiens
  misc_feature: GYAE6OF02FNUI6.16.81.H04.1.454.CMB.1.raw
  modified_base (270)..(270): a, c, t, g, unknown or other
  misc_feature (270)..(270): n is a, c, g, or t
  modified_base (405)..(405): a, c, t, g, unknown or other
  misc_feature (405)..(405): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacncccctaagctccctgatctatgatgtctcaatagtaggaaaggtcgggtacccagtacaaggttcaggcggcgagtgatcgtggacagaatcactctcactatcagtcagcctacagccgtagatgtatttacgntacgtttattattcgaacctaacgtaagttaactaagtacgtttacttaccgtacgtttccggacccgttaggaaccctaagtcgtaggaacttagtaaccgaaacgtacgtcggtagtccgtagactaccgtattcgttacgtcccgttac

SEQ ID NO: 167778 - DNA, 954 bp, Homo sapiens
  misc_feature: GYAE6OF02F1DGN.16.81.H04.1.454.CMB.1.raw
tcagtgtactactccacgaccggtgctcgatttagtagtgtagattcgcgggggtcagactcagtcaggacacagcatggacatggagggtccccgcctagacgtccctcgggtcgggtcccttccgtgtcgtcgtccttcggtaccggtcccctacccggtaaggttacctaaacgtaaggttcggaccgaactaccctaccggaagttacggtaccccgaacccgttagtttccccctttacccccttaccccctaccggtttcgttccgccgtaacttccgttcggttaccgggaaccggaaccgacgaacggttaccgtacccaacttacgtacccgttacggtcccggggaccccgtacgttacgaggtaacgttcgggtttacgggtttacccgtacggtttggggttcccggttcggttaggttaccaagacgaaccggaaaaccggaacgggtaaacggtaccccctaacgtacgtcccgtacgtagttacttacgttaggtacgttcgttccgtaaccctaagtaaagtaccggggtaaaggtaccggggttcccggtaactaggttaacggttacgtacgcggtacgaggtttacggtggtaccgttcggggaacgtataaacgttacctacccgttacctaccgaccaacgttcgaccgacgacctaccgaccgtacgtccgtacgtagttacgttagtttaccggtacgttaactttctttaacgtacgtaccccgtaaagtaccgttaagttaaaccggttaagttttacccgttaacttaaccccggtttaccgggtttccccgaaccgggttaccttaagttaccgtaggtaaccgttaacgtttaacggaaaaccccgtaagggtttcccggaaggtttaccccgagtaacccggttcccctaaacggtttcttcccggtttaccttcgttaaccccc

SEQ ID NO: 167779 - DNA, 535 bp, Homo sapiens
  misc_feature: GYAE6OF02G106U.16.81.H04.1.454.CMB.1.raw
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
  modified_base (487)..(487): a, c, t, g, unknown or other
  misc_feature (487)..(487): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacgttgccggccagtcagtagttgttcggtacctggttcggccttggtatcgagacaagaaaccgagggaaacgcccctaaagcctcctgactctatgatgtctccaatataggaaagtgggtccagtcaagtcagcgcagtgatcgngganagtatcactcncacntcagcacgtccacagctgattacgtntttacgcgtactttattacgttcgacctagattaagtaagtactttagtacttaacgttccgccgtaggaacctagttcgtagtattanaacgaacgtacgtcgtagtctcggacctaccgtatcgttactcgttac

SEQ ID NO: 167780 - DNA, 722 bp, Homo sapiens
  misc_feature: GYAE6OF02HNLT3.16.81.H04.1.454.CMB.1.raw
tcagtgtactactccacgaccggtgctcgatttagtagtgtagattcgcgggggtcggactcagtcaggacacagcatggacatgagggtccccgctcagctcctggggctcctgctgctctggctccaggtatcaatgtgacatccagatcgaccagtctcctccacctgtctgcatcgtgtcggagacagacgtcacctatctacgttcgccggctagacagagttgttacggtactgggttgtccgtggtatcgacgacgaacgtaaaaccgacgggtaaaccgtacccctaaaggcctaccgtagacttacctaagtgtacgttcgtacttacctaaagtacgtaaggggtaaacggttcgggtacctaagtaccgtaaggttcgaacggcggataaggcgtaacgtcggtagggtaacaagttactactacctacgtaccaactacgtacgacgtacgtaacccgtaccgtaacgtacggtacctagtacgttacgttaacgtttcgaaccgtttaacgttttaatacgtttaaccgaaacgtaaacgtaaacgttaaagtaacgttttaacggtttaaccttacccggttaaccgtttacccgggaccgttaaacgtaactaacggtttagaccgtaagtaacgtaaccgtaaaacgtcgtacggtagtaccgagtacccgaacttacgtaccgtttcgttaccctagttaccccg

SEQ ID NO: 167781 - DNA, 775 bp, Homo sapiens
  misc_feature: GYAE6OF02HGN3Z.16.81.H04.1.454.CMB.1.raw
  modified_base (745)..(745): a, c, t, g, unknown or other
  misc_feature (745)..(745): n is a, c, g, or t
  modified_base (757)..(757): a, c, t, g, unknown or other
  misc_feature (757)..(757): n is a, c, g, or t
tcagtgtactactccacgaccggtgctcgatttagtagtgtagattcgcgggggtcggactcagtcaggacacagcatggacatgagggtccccgctcagctcctggggctcctgctgctctggcctcccgaggtatcaaatgtgacatccagatcgacccagttcctcccttcccaccctgtcctgcatctggtcgagacagacgtcaacctatccgtacgttccggaccggccaggtacgaggtgttggttcggtaccgttgggttcggccgtggtactcgagacaaacggaaaccggaacggaaaccgtacccgtaacgtccttaccgtagtacttacgttagttagtacgttccgtacctaccgtaaagttacggttaaacggggtaaacggttccgggttaccctaaggttaacgtaacgggttaccgaggaccggtgtaaggtcgtacggtcggtacgggtaactaacggtactttacgtacccttacctaccctaacgtacgtaccacggtacctaacggtaccaaccgttacgtacgttcgtaattacgtttacgtttactaaccgtttacttttaattacgtacccgaaacttaacttaaggttaaactaaggtttacctttaggttaacccctttaaggttcccggtaccgtacggtaacacggtttacgaagttacgtaaccgttaaccgtaaacggttcggtagttacccggacgttaaccgccttaaccgtntttaacccgttnttccccgttacctacccg

SEQ ID NO: 167782 - DNA, 777 bp, Homo sapiens
  misc_feature: GYAE6OF02H40L5.16.81.H04.1.454.CMB.1.raw
  modified_base (97)..(97): a, c, t, g, unknown or other
  misc_feature (97)..(97): n is a, c, g, or t
  modified_base (560)..(560): a, c, t, g, unknown or other
  misc_feature (560)..(560): n is a, c, g, or t
tcagtgtactactccacgaccggtgctcgatttagtagtgtagattcgcgggggtcagactcagtcaggacacagcatggacatggagggtccccgntcagctccgtggggcctcctgctgctctcggctcccgaggtactcaaaagtgtagacatccgagatcgacccagtcctcccttccaccttgtctgctactcgtggtacggagacgagacgtccaaccgtatcctacgttcggcccgggctaaggtcgaggtacttcggttcggtaccgtggttcggaccgttaggtactcgacggtaaccgaaacggaaaaccgaaggggaacccttaccccgtaagtcccttaccgtagtaacgttacctaaggttcgtacgttccgttaacgtaacctaagtttacgtaagggtaacgggttaccggtacctaacgttacggtaacggttacggacggtccgacggtaacggttcggagtttcgggaacggtaactaacgttaacgttcaccgttacgacctaagtccacgtacgacgacgtaccgtacgacgtactagtnttacgtttacttccggttaactttaacgtttacttacgttacgtaacgtaacgttaacgttaaggttaacgttaacgtttaccgtttaccgttaaccggtttccgtacccggttaaggtaacccgtaggtagttaccggaacgtaaccgtaaagtaacccgtggttaacgtcgtacccgtgtacccacgttaccgtcggttccttacccgttaaccc

SEQ ID NO: 167783 - DNA, 730 bp, Homo sapiens
  misc_feature: GYAE6OF02GLYFT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctcccttcccaccctgtctgctatctggtcggagacagtcgtaccaccactctaccgttcggcccggtacagtacaggtagttcggttacggttaccgttgggttacggccgttaggttactcgaacgacaaacggaaaaccggaaagggaaacccgtacccccgtaaaggtccctaccgtatacttactagtacgtagttcctacctaacctagtaaaaaagtcgggtaacggtccgggtaccctacgtacgtaacggtcgacggcgacgtaggtacggtagtcggtaggtaacgtaagttaacttccgtactacccgtacctaacctagaccgaacgtccaccggttaccaacgccgtacgtacgtatacggtttcgttacgttacgtttaactttacgtttacggtaccaaccttaagttaaacgttaagtaaacgtttacgtttaactttaccgttaacggtttaccgtcccggtaacggtacctagttacggttacgtaacgttaacgtaacgaactacgttacggcgttagtccgtacgtacctgttactcgttacctacg

SEQ ID NO: 167784 - DNA, 828 bp, Homo sapiens
  misc_feature: GYAE6OF02JZHJ3.16.81.H04.1.454.CMB.1.raw
tcagtgtactactccacgaccggtgctcgatttagtagtgtagattcgcgggggtcgagactcagtcaggacacagcatggacatgagggtccccgctcagctcctggggctcctgctgctctggctcccaggtatcaaatgtgacatccagatacgacccagtcctcccttccaccctgtctgcatctggtcggagacaggatcaccatcacttggcccggccagtcgagtacgttgtcggtaccgtggttcggcctggtatcgagcagaacaggaacgccctagactcagactcagtgatcgtctacctaatactagggtaagtcgggtcctagtccgaagttcgacgtcggacgtagtcggtagtacggtacggaacgtagtacgttacgtaccttacgtacctaccctaagttaccgaacggtaccgtacggtaccccctaacgtaccggtaaccgttaacgtaccggtttaagtttacggttttaccgttaaccggtttaaacccgttttttaaagttaccgttaaaccgtaacccgttaaaccgggttaaacttttaaaaacggttaaaccggggttttaaagtttttaaaccttaacccggtttttaaaccccgggtttaccccgggttttaaccccgggttaaaccgggttaaaaccctttaacggggtttaaaccggttacggttaacccgtttttaaaacggtaaaccccgggtaaaccctttaaaccgggttttacggggaacccggtttaacgtcccggttaaaccgttacccttaaaccggtttacccggttttcccgtttacggtttaaccccc

SEQ ID NO: 167785 - DNA, 594 bp, Homo sapiens
  misc_feature: GYAE6OF02FNMS0.16.81.H04.1.454.CMB.1.raw
  modified_base (192)..(192): a, c, t, g, unknown or other
  misc_feature (192)..(192): n is a, c, g, or t
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctcccttccaccctgtctgcatctgtcgganacagatcaccatcacttgcccgggccagtcagagtgttggtacctggttgctggtatcagcagaaaccagggaacncccctaagctcctgatctatgatgtctaccaatntagggaaagtcgggtaccatacgaagttcagcggcagtgatcgtagggacagtaacttcactctacaccatacacgacacgtacctaacgacgtcctagacttacgtattttacgacgtttaactttattacttaacggtacctaaagtaacgttaagttaaacgtaagtttactttaccgttaaccgttttaccgtaccgttacggtaacctaagttacgtagtactagtaactaaacgtaaccgtgtacggtacgttgacctacgtaacttcgtagttacctaccgttcg

SEQ ID NO: 167786 - DNA, 727 bp, Homo sapiens
  misc_feature: GYAE6OF02FIKK7.16.81.H04.1.454.CMB.1.raw
  modified_base (234)..(234): a, c, t, g, unknown or other
  misc_feature (234)..(234): n is a, c, g, or t
tcagtgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatcgacccagtctccttccaccctgtctgcatctgtcggagacagacgtcaccatccacttgccgggccagtccagngtggttggtaccgtggtggcctggtactcagcagaaaccgagggaaccgacccctaagcctcctagacttactagtgacttcgtcctaccgaattagtaggtaaacggtcgggtacccagtacgtaacggttcacggtcggtacgaggtacggtacgtaccggttaggggaacctaacggtaaacgttttccaacccgttaccgttacccgaacccgtaaacttccgaacgtaccgtaacggtaccccttaacgacccgtcccttaggtacgttacgttacgtttttacggaccgtttaactttacgttaaccgttacgtaccctaaaacggttagttaaacgttaaacgtttactttacgttacccgttaaacgttcccggtaccggtaacggtaccaaggttacggtacgtaacgttaacccgtaaccgtaaacccggttacggttacggtacgggtccttaccgggacccttaccggtaccttacccggg

SEQ ID NO: 167787 - DNA, 719 bp, Homo sapiens
  misc_feature: GYAE6OF02HYHT1.16.81.H04.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (657)..(657): a, c, t, g, unknown or other
  misc_feature (657)..(657): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgaccagtctccttccacctgtctacatctgtcggagcagngtcacatcactcggaccggcagtcagngtgttcggtacgtggttgcctggtatcagacgaagaaaccgaggggaaaccacccgtaagccttccgagtactcgtaagtgacttacgtacctactaaagttaggttaaggggtaacggtttccggggtaaccctaagtaccggttaaaggttccgacgggtacggacgtaggtggaacgttcggacggtaacagtaactttccaacgttctacccgtactacgtacgtacgaccgtacgtaccgttaaccggacttaccgaggttaacttcggttaacgtttttcgaccgtttaacgttttaatttacgtaaccgtacctaaacgtaagttaagttaaacgtaacgttttactttaaccgttaaaccgtttccggttccgtaccgggtaactaaacgttcgtaagttacttaccgtaaaccgtaaacggttacgnggttaccgcgtacgtacgtaacccgtacgtttccgtttaacggttccttaccgtttaccccg

SEQ ID NO: 167788 - DNA, 626 bp, Homo sapiens
  misc_feature: GYAE6OF02HHP8Z.16.81.H04.1.454.CMB.1.raw
  modified_base (609)..(609): a, c, t, g, unknown or other
  misc_feature (609)..(609): n is a, c, g, or t
tcagtgtactactccacgaccggtgctcgattttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcgccggcagtcagagtgttggtacctggttcggcctggtatcgagcgaagaaaccgaagggaaacgacccctaagcctccgtgattctatgtatgtctaccaatagtagggaaacggtcgggtaccagtacgtaaggttcgacggcggacgaggtggtagtcggtagggaactagtaacttccactcctacaccatccgatccaacgtcctaacacgtcctagtactgttactttcgacgttaactttacgttatacgtaacctaaagtaagtttaaacgttaaagttacgtttaactttaaccgttaaccgttttccggacccgttaggaaacctaggttacgaggttaactacgtaacgtaaacggtaacgtggtacgtactacggtactaaccgtnttacttcttacttaccg

SEQ ID NO: 167789 - DNA, 695 bp, Homo sapiens
  misc_feature: GYAE6OF02F1PE3.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccggccagtcagagttgttcggtacctggtcggccgtggtatcagcaacgaaaccgaggaacgccctaagcctacctgactctatcgatcgtctacctaatagtagggtaaaggtcgggtacccagtacgtaaggttacgacggcggacgaggtacggtagtcggtagggactaagtaacgtactacctctaccaacctagtaccaacgaccgacgtacccctaacgaccgtaccgttagtaattacggttaacttttcggaacgttaacttttaactttacgtaccggtaaccctaaacgttaagttaaacgttaaacggttagttttaactttaaccgttaaccggttttacccgggtacccggttacggtaaacccttaaggtacggttagggtaacttaacgtaaaccgtaaaccggttaacggttcggtaccggtaccgttacgaccctaaccgttacgttaccgttacgttccttaccg

SEQ ID NO: 167790 - DNA, 650 bp, Homo sapiens
  misc_feature: GYAE6OF02IPK83.16.81.H04.1.454.CMB.1.raw
  modified_base (498)..(498): a, c, t, g, unknown or other
  misc_feature (498)..(498): n is a, c, g, or t
tcagtgtactactccacgaccggtgctcgatttagtagtgtagattcgcgggggtcagactcaggtcaggacacagcatggacatgagggtccccgctcagctcctggggctcctgctgctctggctcccaggtatcaaatgtgacactccgagatcgacccagtcctcccttcccaccctgtctcgctactcgtgtcggagacagacgtcacctatccacgttcggcccgggacagtccgaggtagttcggttacggtaccgtgggttacggtccttggtactccgacgtaccaaacggaaaccgaacgggaaaccgccccgtaaagcctaccctagactacttagtagtacttcgtactaccaagttaggtacggtaacggtccgggtacctagtacgtaacggtcaggtcggacgtaggtcggatcggtggaactacgtacttcacctcgtaccactacgtacacgccacggacctagacgtcctgtattagttntttacgtacgttaactttacttactactaacaatagtacttaaggtacttaccgttacttaccgtttccggaccggttacggaacgtagttcggagtaacgtacgacgtaaacgtcgtcgtacgacacgtcaacccttgtccttctgttccc

SEQ ID NO: 167791 - DNA, 832 bp, Homo sapiens
  misc_feature: GYAE6OF02I1P3G.16.81.H04.1.454.CMB.1.raw
  modified_base (178)..(178): a, c, t, g, unknown or other
  misc_feature (178)..(178): n is a, c, g, or t
  modified_base (191)..(191): a, c, t, g, unknown or other
  misc_feature (191)..(191): n is a, c, g, or t
tcagtgtactactccacgaccggtgctcgatttagtagtgtagattcgcgggggtcagactcagtcaggacacagcatggacatgacgggtccccgctcagcctcctggggctcctgctgctctggctcccaggtatcaaatgtgacatccagatcgacccagttcctcccttacccnccctgtctcgctnttcgtcggtcggacgactaacggacgtccaaccataccgtaccgttcgggccccgggacctacgtaccgtaggtaaggtttcggttcgggttacccgtgggggttcggcccgttagggtactccgaaggtaccgaaacggaaaacccggaaaggggttaaacccgacccccgttaaacgtccgttaccccggtaagttaccttaaccgtaagttacggttaccgttaccgttacccgttaaccttaaaggttaacggttaaacgggtaaaccggggttccgggtaacccttaacgttaacggtaaccgggttacgaacggaccgggtaggtacgggttacggtacggtaccggttaagggacggtaaagttaacccttacgtacctaccgtaccacgtacgtacgtacgaccgtaccgtacgtaccgtaccgtacgtacgttacgttacgttacgttacggtacgtttacgtttacgttaaccgtacgtaacgtaacgtaagttaaacgttaagttacgttaacttaccgttacgttaccgtacgtaccggtaacgtagttacgtaggttaactaacgtacgtaaacgtcgtacggttacgtcgtaccgtctaaccggtctttaccgtcttacgttacccg

SEQ ID NO: 167792 - DNA, 748 bp, Homo sapiens
  misc_feature: GYAE6OF02GMHC1.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccattcacttgccggcagtcagagtgttggaccttggttcggcctggtatacaggccaaggaaaccgacgggaaacgccccctaaaggccttccctagaattcctaagtcgaagttcgtacctacctaaattaggtagggaaaacggttcggggtaccccagttacgtaaaacgggttcgaaggtccgggtacaagggtcggtacgttaccgtaggggaaactaacgtaaactttccaaccttcgtacccaacgtacttaccgacgtaccaccggtaccttaacgacggtacccgttaggtaacttacggttacgtttttacggttacgtaaccgttttttaactttaagtttaccgaacccgttaaaagttacgttaaagtttaaacgtacgtttttaaactttaccgttaaccgtttttaccgggaccccgttaacgggtaaccttaagttagttacgggtaactacgttaaaccgtaaaaccgttacgggttaggtcgtaccggtacacccgttaacgtaccttcggtttaccacttttaacccg

SEQ ID NO: 167793 - DNA, 735 bp, Homo sapiens
  misc_feature: GYAE6OF02GAM4J.16.81.H04.1.454.CMB.1.raw
  modified_base (205)..(205): a, c, t, g, unknown or other
  misc_feature (205)..(205): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccgagatcgacccagtctccttccacctgtctgctatcgtggtggagcagagtcacntcacgtcgccggcacgtcagtagtgttacggtactggtcggacctggtactcagacaacgaaaccgacgggaaacctccccgtaaggtcctaccgtagtactcgtagtacgattccgtccaaccgtaagtagtaacggggtaaacgggttcggggttaccccaattaaccggtaagggttaccgtacggacggtacggtaggtacggtacgtacggtacggggaactacgtaacgttaccaccgttctacctaaccacgtacacgacgtaactacccgtaactaccggtacttacgtaacgttcgttaacgtttcgtaacgtttactttacgttaacgttaccgaacctaagttaacggttaataaacggttgttttaacgttaccgttaaccgggtttaccggacccgttaacgggtaaccgtaacggttagggttactaaccggttaacgttaaccgtaaaaccggtacgtcggttaccggtagttaccgacccgttaacgttcttaacggtttcctacgtttacccg

SEQ ID NO: 167794 - DNA, 538 bp, Homo sapiens
  misc_feature: GYAE6OF02HOO3H.16.81.H04.1.454.CMB.1.raw
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttggccgggccagtcagagtgttggtacctggttcgcctggtatcagcaagaaaccagggaaacgcccctaagcctacctgatctatgatcgtctaccaatagtaggaaaggtcgggtacccagtacgaaggttcaggcgganaggtgatcgtaggactagtaatcactcncactncagcagcctagncctntatgtatttcgacttattattatcaccaatagttataagtcgttacttactacgtttcgaccgtaggaacctagtggtagaacttacgtaacgtaactacgtggtacggtactcgacacctagtcttacgtccttaacg

SEQ ID NO: 167795 - DNA, 646 bp, Homo sapiens
  misc_feature: GYAE6OF02IKYC9.16.81.H04.1.454.CMB.1.raw
  modified_base (279)..(279): a, c, t, g, unknown or other
  misc_feature (279)..(279): n is a, c, g, or t
tcagtgtactactccacgaccggtgctcgatttagtagtgtagattcgcggggggtcagactcagtcaggacacagcatggacatgagggtccccgctcagctcctgggggctcctgctgctctggctcccaggtatcaaatgtgacatccagatcgacccagtcctcccttccaccctgtctgcatctgtcggagacagacgtcaccatctacgttcggccgggaccaggtcaaggtaggttggttacggtaccgttggttcggccgttagggttaanccgaagacgaaacgaaaccggaagggaaacgaccccctaagtcctaccgtagtactactaagtgattcgtactaaccaatacgtaggaacggtcggtaccagtaccgaagttcacggtcgagacggtagtacgtcgaggaactagtaactcgactcgtacacactacacgacacggcctacagacctagaacgttagttagtttacgaccgttaatttaatcttacgaaccaagtaagtaacggtaagttattaacgttaaccgtaaccgtttccggaacccgtagggtaaacctagttaggtacgaactaagaaaccggtaacgtagtcgtcgtactacggactacgtacgtctacgtacttaccg

SEQ ID NO: 167796 - DNA, 751 bp, Homo sapiens
  misc_feature: GYAE6OF02JGSSF.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttcggccgggtccagtcagtacgtgttcggtacctggtcggcctggtactcagcacgaaaccgagggaaacgcccctaagctccgtagactctatgactcgttcctacctaatagtacgggaaaggttccggggtaccagtcgtaacggttcgacggtcggacgtagggtcggacttcggtagggtaccaaggtaacttacgacccttaccgtaccaaccgtaactacgaccggtacgaaccggaccccgttaaccgtacggtaccgttacggtaacgttcggttaacgttttaccggaaccgtttaaccttttaggtttaccttaccggtaaaccctaacgttaacggttaacttaaacggttaacgttttaacgttttaaccccgttaaaccgggttttccccgggaacccggtttacgggtaaacccttagggttaccggtacgtaacgttaccgtaaacccggtaaacggtaaacccggttgtaacgggtaccttaacggcccttaaaccgtccgtttaccttacggttcccttaaccgg

SEQ ID NO: 167797 - DNA, 720 bp, Homo sapiens
  misc_feature: GYAE6OF02IUVQY.16.81.H04.1.454.CMB.1.raw
  modified_base (164)..(164): a, c, t, g, unknown or other
  misc_feature (164)..(164): n is a, c, g, or t
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
tcagtgtactactccacgaccggtgctcgatttagtagtgtagattcgcgggggtcgagactcagtcaggacacagcatggacatcgagggtccccgctcagctcctggggctcctgctgctctcggctcccaggtactcaaatgtgacatccagatcgacccngtcctcccttccacccttgtcctgcgatctgtacgganacagcgtcaccatcacgttcgccggcacgtcagagttgttcggtaccgttggttcggaccttaggtatccgaggcaacggaaacgcgggaaaccnccccgtaagcctaccgttgaacttcgtactcgattccgtacctaccgtaaagtacgtaagggtaaaccggttcggggtacccctaagttaccggtaaacgggtttccaacggtacccgggtgtaaagggttcggggtaactttcgggtaacgggaaacttacgtaaacctttcaacccgttacttacccgaacctacgtaccgtagaccgtaccgtacccgtacgtacgttacccgtgttaacgttcgttaacgttttcgacgtttaacctttattacgttaccgtacaaacgtacgttacgttaagttactttacgttctaaccgtttccgaccgtacggtaactagtccggattaacgtacgtaacgtaacgtacgtcgtaacggccttacggaccacttacggttcttcggtaacttccg

SEQ ID NO: 167798 - DNA, 737 bp, Homo sapiens
  misc_feature: GYAE6OF02HJ1Q7.16.81.H04.1.454.CMB.1.raw
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtgacatccagatgacccagtcctccttccaccctgtctgcatcgtggtacggagacgagacgtaccaccatccacgttcggcccgggaccagtacaggtagttggtttcggtaccgttgggttcggccgttggtatcgagacaacggaaaccgaagggaaaccgaccccgtaagccttcgtagtatccgtatagacgtcgtacctactaagtagtacgggtaaacggtccgggtacccagttaccgtaacggttacgacggtcggtacgtaagggtcggtaacgttacggtacgggtaacgtaagtaacctttacccgaacccgttccctaacccaacccgttaaacgtaccgaacccggtaccgtaaccgaccccgttaacgaccggttacccgttagtaacgtttacgtttacgttttacggtacctttaaactttagtttacgttaccaaccgttaaactaggttaaccttaagttacgtttacgtaccgttaacgttcccggtacgtaacggtacctagtcggtagtattaacgtaacgtaaacgtcgttagcggtccttacgacctacgagtttcccgtattacccgtac

SEQ ID NO: 167799 - DNA, 711 bp, Homo sapiens
  misc_feature: GYAE6OF02JAK6Q.16.81.H04.1.454.CMB.1.raw
  modified_base (276)..(276): a, c, t, g, unknown or other
  misc_feature (276)..(276): n is a, c, g, or t
tcagtgtactactccacgaccggtgctcgatttagtagtgtagattcgcgggggtcagactcagtcaggacacagcatggacatgagggtcccgctcagctcctggggctcctgctgctctggctcccaggtatcaaatgtgacatccagatgacccagtctccttccaccctgtctgcatctgtcggagacagagtcaccatcgtacgtcgccggaccgacgtacagtagtgttcggtacgttggttacggtccgttaggtactacgtacgacgnaaacggaaaccgaacgggaaaccgtacccgtaacgaccgtacgtacgtacgttacgtacgtacgtacgtacgtactaccgtaagtaacgtaacggtaacggtacgggtaccgtacggtacgtaacggttacgtacggtacggtacggtacggtacggtacggttacggtacgggtaacgtaacgtaacgttacgtacgtacgtacctacctacgtacgtacgtacgacgtaccgtacgtacgtacgtacgtacgtagttacgttacgtacgttaacttacgttacgttacgtaacgtaacgtaacgtaacgtaacgttaacgttaacgttacgttaccgttaccggtaccgtacggtaaccgtacgttacgtacgtaacgtacgtgaacgtaacgtaacgtacggtacgtacgtacgtaccgtaccgtacgtacg

SEQ ID NO: 167800 - DNA, 705 bp, Homo sapiens
  misc_feature: GYAE6OF02I2AD0.16.81.H04.1.454.CMB.1.raw
  modified_base (338)..(338): a, c, t, g, unknown or other
  misc_feature (338)..(338): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctcccagtatacaaatgtgacataccagatcgaccctagtctcccttacccaccctgtctgcattcgtgtccggtagacagacgtacacactcacgttcgccgggctacgcaggtagtgttcggtacgttggtcgaccgtggtataccgagtaccgaaacgaaaccgaagggaaacccgacctaacgtctcgtagtacgtactaatcggttanacgttacctaactaagttacggtaagggtaaacgggtccggtacctaacgtacgtaggtacgacgtacggagacggtgtacgtcggtaagacgtagtacttcactcgtacctaacataccgtaagccgtaaccgcgttaaccgaccgttgtaacgttacgttcggttaacgttttacggaaccttagtttttacgttaacgtaccgtaaactaacggtaaacgttaaagttaaacggtttacgtttaacttaaccgttaccggttacgtccggtaaagaccgttaagttcggtaacgaacttaccgtaaataacccggtaagtccgtaggtacctcaaacgttccttaggtcttacggttcttaccg

SEQ ID NO: 167801 - DNA, 807 bp, Homo sapiens
  misc_feature: GYAE6OF02HFIRQ.16.81.H04.1.454.CMB.1.raw
  modified_base (650)..(650): a, c, t, g, unknown or other
  misc_feature (650)..(650): n is a, c, g, or t
  modified_base (766)..(766): a, c, t, g, unknown or other
  misc_feature (766)..(766): n is a, c, g, or t
tcagtgtactactccacgaccggtgctcgatttagtagtgtagattcgcggggggtcagactcagtcaggacacagcatggacatgagggtccccgctcagctcctgggggctcctgctgctctcggcctcccaggtatcaaatgtgaacatccaggatcgacccagtccttcccttacccacccttgtctgactattctcggtcggaacgacgacggataccaacctactcaccgttccgggcccgggtaccaggttacgagtaggttcggttcggtaccggttgggttcggccgtaggttactcgacgacgaaacggaaaccggaacggtaaccggtacccctaaggtcctccgtagtacctcttaacgtacgtagttacccgttacgtaacctaaggtaaacgttaaggggtaacgggtaacccggggttcctaacgtaacggttaaccgggtttacgaacgggtccgggaggttaacgggtacggttaccggtttcggaagggtaaccgtacgtaaacttccgaaccttacctaaccgaacgttacaccggtacgaacccggtacccgtacctaaccggtggtaccgttagtacgttaagttttaccggtttcgttaaaccgtttactttaaatttacccggttanaaacccgttaagtaacgttaaagtttaaggttccttaaacgtttaccggttaaccgtttccggacccggttagaacccgtttagtacggttataactaaaggtacccaagttaccngggtctcgtacctacacctttagtactttccggtattaccc

SEQ ID NO: 167802 - DNA, 766 bp, Homo sapiens
  misc_feature: GYAE6OF02H6N0Z.16.81.H04.1.454.CMB.1.raw
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
tcagtgtactactccacgaccggtgctcgatttagtagtgtagattcgcgggggtcggactcagtcaggacacagcatggacatggagggtcccccgctcagctccgtgggggcttcctgcctgcctcgtggcctccgaggttactcaatggtgacagtccagatcggaccctagttccttccccttccctaccgttgtccgttgcctactcgttacggtaccgaacgtaccgagtacggtaccaaccctaacgttccgaccggtttccgggcccggggtcctacggtaccgtaaggtcggtttcggttttaacgggtacgttcgggggtttcggcccgtttgggtaacctgaacggaccgaacgggtaaaacccgacggggaaaaccgtacccctaaggtcctaccggtagtacctntttaacgngtaacgtttcggaccctttaccgtaaattacgggaaacggtttaacgggtccggtaacctacggttaccgtaacgggtacgacggaccggtcggaagttcgtaagcgtaggacgttagtacctcatccgtacaactcgcagtacgtaccgtacgtacgtacgtccgtatacttgtacgttagtaccgttacttagttacgtacgtacctaataacgtaacgtacgttaatttaccgtaccgttaaccgttccggtaccgtacggtaatacgtaggtacattacgtaacgtaactaggtcgtcgtactacgctacgtaccttcgtacgttactcgttaccg

SEQ ID NO: 167803 - DNA, 662 bp, Homo sapiens
  misc_feature: GYAE6OF02FT5AD.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcaagaaaccagggaaacgcccctaagcctcctagctctatgatgtctacctaagtagtagggtaaaggttcggggtaccctaagtccgtaaagggttcgaacggtcggacgtaggtggtaagtccggtaggggaaactagtaacgttccgtaccgttacctaccgtaacctacgtacaacgactacgacccctaacgacgtaccctaggtacgttagttacgttttacggacgtttaactttaagtttacttacggtaaccctaaacgtaagttaattaaacggttacgtttaactttaccgttaaccgtttccggacccgtacggtacctaagttcggtagtaacttagtaaccgtaaacgtagtcggtacggtccttaggacctactacgtttctacgttcttaccg

SEQ ID NO: 167804 - DNA, 633 bp, Homo sapiens
  misc_feature: GYAE6OF02FRSU9.16.81.H04.1.454.CMB.1.raw
  modified_base (249)..(249): a, c, t, g, unknown or other
  misc_feature (249)..(249): n is a, c, g, or t
  modified_base (281)..(281): a, c, t, g, unknown or other
  misc_feature (281)..(281): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacgttgccgggccagtcagagtgttggtacctggttgcctgtancagcaagaaaccgaggaaacgccctaagctcngatctatgatcgtactaccaagtagtaggaaacggtcgggtacccagtacgaaggttcagacggctaggtcggattcggtacggaacaggtaacttaccgacttccactaccactacgacgtacgacgtacctaacgaccgtaccgtagtacgttgttaacgtttacggaccgttaacgttttattaaccgtagtaccctaaagtagttaaacaaagtttagttacttaacgttacgtttaccggacccgtaggtaaccctagttaggtagttaactaagtaacccgaaaacgtcgtacggttacggtacgtacgtacctaacctacggtttactaccggtttactaacccg

SEQ ID NO: 167805 - DNA, 658 bp, Homo sapiens
  misc_feature: GYAE6OF02FTMK1.16.81.H04.1.454.CMB.1.raw
  modified_base (304)..(304): a, c, t, g, unknown or other
  misc_feature (304)..(304): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtccaccattccacttcggcccggccagtccagagttggttcggtacctggttcggccgttggtactcgagcgaagaaaccgaagggaaacgcccctaagccttaccngactctatgtatgtcctaccaagtagtagggaaacggtcgggtcccagtacgtaaggtccaggccggagaggtcggtatcggtacgggataagaattcacttcaccactatacgagcacgaccgtcacggtcctagtacttagttacgttttacgacgttactttattacgttcgtaaccaaagttacgttaattaaacggttaatttacgttaaccgttaaccggtttccggtacccgttaacgggaacctaagtttgggtaacgtaacttaaccgtaacaaaaccggttagttacggttacggtactaccggtacctaaccgtacgtttacgtttcggtaccttttaacccg

SEQ ID NO: 167806 - DNA, 543 bp, Homo sapiens
  misc_feature: GYAE6OF02GN5VT.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcacatcacttgccggcagtcagagtgtgactggtgctgtatcagcagaaacaggaaacgccctaagcctcctagatactatgacttgtactacgaattataggtaaacggtgggtcccagtacgaaggttcagcggcagtgatcgtggacagtacgttcactcacacatcagcagacctacacgctgatgtatttgactatttatatagactaaagtagtaataagtagttacttacgtaactttccggaccgttacggaactagtagtacggtaattaacgaaccgtaaacgtacggtagtcggtacgtcgaccctaactacgtttcgttacgttcctttaacg

SEQ ID NO: 167807 - DNA, 642 bp, Homo sapiens
  misc_feature: GYAE6OF02GBG30.16.81.H04.1.454.CMB.1.raw
tcagtgtactactccacgaccggtgctcgatttagtagtgtagattcgcgggggcaggagtcagactcagtcaggacacagcatggacatgagggtcccgctcagctcctgggctcctgcctgctctggctcccaggtatcaaatgtgacatccagatgacccagtctccttccaccctgtctgcatctgtcggagaccagagtcaccatcacttgccgggtccagtcagacgtgttggtacctggttcggcctggtatcagcaagaaaccaggggaaacgccctaaaggctcctgatccgtatgatgtctacaacttagtggaaagtcggggtaccatcaaacgggttcaagcggtcaggtacggtatcgtagggtacaaggtaaatttccgaacttcgtacaacccgtatccgaacgtcgaacggaccctaacgaccgccctagggtaacttacgtacgtttttcgaccggttaacttttagtttaccttcggtacccaaacgttagtaacgttaaagttacgttaaactttaccgtaaaccgttttcgggaccccgttacggggtacctaaggttcggttaaggtaatacctaaccgtaaaacgtacttggtacggtaccgtagtcccaactcttaccg

SEQ ID NO: 167808 - DNA, 529 bp, Homo sapiens
  misc_feature: GYAE6OF02FOSHL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaaggcctcctgatctatgatgtctccaatatggaaaagtggggtcccagtcaaggttcagcggcagtggatagtgggacagaattcgactcgtcacatcagcagacctacagcctgatagattttggcgtactttattagttgaccaacagttaactaagtagtttattacgtaactttccgggaccttagggaaccctaagtagttggatagtacaaacgactgttaggctaggcaacgattctagtcttaccg

SEQ ID NO: 167809 - DNA, 791 bp, Homo sapiens
  misc_feature: GYAE6OF02GAJAW.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtctccttccaccctgtctgcatcgtgtcggagacagacgtcaccatctacttcggcccggcaagtcaggtagttggttcggtaccgttgggttcggccgttagggtaactcgacgacgaaacggtaaaaccggacgggaaaccgtaccccgtaagcccttacccgttagtaacgtttccttaagtacggtacttccggttaccctacccgtaaaagtttaacggtaacggggtaaaacgggttccgggggttacccctaacggttaaccggtaaacggggttttaccgaacgggtaccggggtacgtaacgggtgggtaacgtttaccgggtaacggggaacgtaaacggttaaacgtttaccctacccgtttaccgtacccgtaaacctatacccgtagaacccgtaacctaacccgtacgaccgtaccgtgttattacgttagtttcgaacgtttaacttttacgttaacgtcctaccgtaaagttaacgttaagtaaacggttacttttaacttaacgttaaccggtttccgggacccgttacggaacgttagtcgggtaagtactaacgtaactaacggtaacgttggtacgacggttcacctacgtaacgtcttccgtattaccg

SEQ ID NO: 167810 - DNA, 1104 bp, Homo sapiens
  misc_feature: GYAE6OF02HOE5U.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtagacataccgagtatcgaccctagtctccgttccacctgtctacgcatctgtacggagacgtagtacgtacactaacttccgacgttacggcccgggtacctacgtaccgtaaggttacggttacggtttacggtacccggttgggggttaccggtacccgtttagggggttactaccgttaaaccggggaaccgaaaaaccggggtaaaaaccccgggttaaacggggggaaaccccgttaacccccccgggttaaacggttacccctttaccccgggtaaggtttaaacccttaccccggttttaaaggttaaccggggttaacctttacccgggtttaacccttaaacccgtaaaaagggttttaacccgggtaaaaccggggggtttaaaaccgggggttaccccggggtttaaccccttaaacggtttaaccggggttaaacggttacccgggaacggtaccgggggttacccggtaaagggttccgggaacgggttttaacccgggaacggggttaaaaccgttaacggtttaactttaaccccgggttaccgttaacccgttaaccccggaccgtaaccggtaaccggtaaaccggtcccgttaaacgtaacccccggtaacgttaccgtaccggtttaccggttaagtttaccgggggtttaaacctttacggtaacccggttttaacttttaacgtttaacccgttaaacccgggtactttaaaaacccgggttaagtttaaaaccggttttaccggtttaaccgtttaaagttttaacccccgtaaccgggtttttacccggggaacccggttaaaccggtaacccgtttaaggttaccggttacgttaaccgttaaaccggttaaaccgtaaccggtaacgggttcccggttaaggtacccgttacgaaccggtttaccctacgggtttcctttaccggttaccgtaacccc

SEQ ID NO: 167811 - DNA, 504 bp, Homo sapiens
  misc_feature: GYAE6OF02F4V2L.16.81.H04.1.454.CMB.1.raw
  modified_base (384)..(384): a, c, t, g, unknown or other
  misc_feature (384)..(384): n is a, c, g, or t
  modified_base (483)..(483): a, c, t, g, unknown or other
  misc_feature (483)..(483): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaacgcccctaagctcctgatctatgatgtctaccaatatggaaagtcggggtcccatcaaggttcagcggcagtggatcgtgggacagaattcactctcaccatcagcacgcctacncgcctgatgtattttgacgtactttattattcgactaacagttaataagtattattctaactttcggcctggaccagtgtgatagtacaactagtgtgntcgacaccgtatctgtcttac

SEQ ID NO: 167812 - DNA, 921 bp, Homo sapiens
  misc_feature: GYAE6OF02F5M7Z.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctacccaggtatcaaatgtgacatccagatgacccagtcctccttccacctgtctgctatcgtgtacggagtacaaggacgtaccgaccacttacgacctttcggccccggggtcctaacgtaccgtaagtagggttagtttacggtaaccgtgggttccggggtaccttagggtaactccgtaacgccgtaaacggaaaacccgaaggggtaaaacccgaccccggtaaaggtacctaccgtcggtaactacgtaagtcggtaacttaccggtaccttaacccgtaaaaggttaacggttaacggggtaaaaacggggtttcgggggttaaacccctaagttaaccggttaaaacgggtttaccgaaggtccgggtaacgtacgggttaggtaacgtttccggtaacgggggtaataacgggttaacgttacgtacccgttaacctaccaaccgtaagtaccgaacgtcgacgtaacctaacggacgtaccgttaagtacgttagtaacgttttaccggaacgttaaccttttaagtaccgtttacgaaaccctaaacggttaacgttaaagtaacggttaaacgtttaacgtttaacccggttaaacccgggttttcccggtaacccgttaaccgggttaaaccgttaaacgggtcggtttaaccggttaacgttaaaccggttaaaaccggtaaaaaaccggtaccgttaaccgggttaaccgttaagggttaccccgtaacgtttaaacccgttacgggttaacccctttaacgggttaacccgttttaaccc

SEQ ID NO: 167813 - DNA, 750 bp, Homo sapiens
  misc_feature: GYAE6OF02FS49R.16.81.H04.1.454.CMB.1.raw
  modified_base (203)..(203): a, c, t, g, unknown or other
  misc_feature (203)..(203): n is a, c, g, or t
  modified_base (446)..(446): a, c, t, g, unknown or other
  misc_feature (446)..(446): n is a, c, g, or t
tcagtgtactactccacgaccggtgctcgatttagtagtgtagattcgcggggggcaggagtcagactcagtcaggacacagcatggacatggagggtcccgctcagctccgtggggctcctgctgctctggcctcccaggtatacaaatgtgacatccagatcgaccagtctccttccacctgtctgctatcgtggtcgganacgagacgtcaccatacctacgttcgcccgggtacacgtcgaggtacgttgttacgggttaccgttgggttcgggccgtttggtaactccgacggactaacggaaaaccggaacgggaaaccggtccccgtaacggccttaccgtcgtaacttacgtagtacgtagtttacggtcctaaacgaaagtttagtacggggttaaacgggtccgggttacccagttaccggtaaaggttcgacggnggtaccgtaggttacggacgttcgggaagtacgaattaccgttcacttaccaccacctaagcgaacggctaacgtaccgtacgacgtacgtacgttaaggttaccgttagtttcggtaccgtttaatttacgtttaaggttcctaccggtaaattacggttaaagttaacgttacggtttaaactttaccggtttaacccgttacggtacccgggtaggtacccgttaagtacgggtttagtaaaccgttctaaaccgttaacgtaagttacgggtcgtactccggaccgtaccttcgttaccg

SEQ ID NO: 167814 - DNA, 605 bp, Homo sapiens
  misc_feature: GYAE6OF02FIIQF.16.81.H04.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (343)..(343): a, c, t, g, unknown or other
  misc_feature (343)..(343): n is a, c, g, or t
  modified_base (411)..(411): a, c, t, g, unknown or other
  misc_feature (411)..(411): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgacccagtctccttccaccctgtctgcatctgtcggagacagngtcaccatcacttcgccgggtccagtcagagtgttcggtacctgggttggtcctggtatnacgacaagaaaaccgagggaaacgcccctaagcctactgactctatgatcgtcaccaatatggaaagtcgggtccattacaggttnagcggcagtggatcgtaggactaagtatacatctacacatcacgcacgctaacgacgacctagagttntaacgttttgaccgttaactttaagttacgttacgaaccaaactaagttaaactaaggttatttaacgttaaccgtaaccgtttacggacccgttagggaaccctaaggttcgttaggaaattaccggtaaacgtaaacgttaccgtcggttagggacctcggacccgtactagttaccgtggttaccttaacc

SEQ ID NO: 167815 - DNA, 843 bp, Homo sapiens
  misc_feature: GYAE6OF02HAWXS.16.81.H04.1.454.CMB.1.raw
  modified_base (189)..(189): a, c, t, g, unknown or other
  misc_feature (189)..(189): n is a, c, g, or t
  modified_base (275)..(275): a, c, t, g, unknown or other
  misc_feature (275)..(275): n is a, c, g, or t
tcagtgtactactccacgaccggtgctcgatttagtagtgtagattcgcggggtcagactcagtcaggacacagcatggacatgagggtccccgctcagctcctggggctcctgctgctctggctcccaggtatcaaatgtgacatccagatgacccagtctcctccaccctgtctgcatctgtcgganacagcgtcaccatcacttcgccggcagtcagtagtgttcgtacctggttgccgtggtactcgacgcgtaagaaaccgagggaaccnccccgtaagcctacctagtactcgtagtcgtagttcgtacctaccgtaagttacgtaacgggtaaacggttaccggggttacccctaagttaccggtaaacggttcgaacggtacccgggtacgtaacggttggtaacgtttccggttaacggggaacctaaagggtaaacctttacccggaaacccgtttaccgtaacccgaacccttacggtaccgtaccgtaccgtaaaccggttccctaaaccgtaccggtccttaacgggtaatttccggttacggttttaccggaccgtttaaaccgtttttagttaacccgttaaccggtaacccctaaaagtttaacgttaaacggttaaaacgtttacgttttaaccgttaaccgtttaaacccgggttttcccgggaacccgttaacgggtaaccctttaaacgggtccggttaacggttaaccgttaacgtttaaacccggaaacggttaccggttacgggttaccggttaacccgttacggtaacccccttaccggttaaaccgtttcccggtttaccggtttaccctttaacccg

SEQ ID NO: 167816 - DNA, 943 bp, Homo sapiens
  misc_feature: GYAE6OF02F0AV9.16.81.H04.1.454.CMB.1.raw
tcagtgtactactccacgaccggtgctcgatttagtagtgtagattcgcgggggtcagactcagtcaggacacagcatggacatggagggtccccgctcagctccgtggggctcctgctgctctggctcccaggtatcaaatgtagacatccagatgacccagtcctccttccaccctgtctgcatctgtcgagacagagtcaccatacacgttcggcccgggtccagtcgagtagttggttcggtaccgtgggttcggccttaggtactcgaacgtaccaaacggtaaaccgaacggggaaaacccgtacccccgttaaaggtccccttaccgttacggtaaccgtttaccgtaagttacggtacgttaccggttaccttaacccttaaaaggttaacgggttaaacggggtaaaaccggggtttcccgggggtaacccccttaagttaaccggtaaacgggtttaccgacgggtacccgggtacgtaaggggtccggtaacgttacgggtacggggtaaaccgtaaacggtttaaccttacctaaccgtccttaacccgtaaccctaacgttaccgaaccgtacgaacccgttacccaacgtccggttaaccgtacgttaagtttacggttacgtttttacggaaccgtttaactttttaacgttaacgttaacccggtaaccttaaaacgggtttaacgtttaaaacggttaacggtttaaaccgtttttaaccttttaacccggtttaacccgggttttaccccgggacccggtttaaaccggggaaccttaacgggtttaggttaccggttaaacttaacccggtaaaaccggtttaaaaccggttaaccgggttaccggttacgggttaacccgttacggtaaacccgtacccggtttaaagtttcccgttttaaccgttacccgttttaaccccgg

SEQ ID NO: 167817 - DNA, 609 bp, Homo sapiens
  misc_feature: GYAE6OF02FW111.16.81.H04.1.454.CMB.1.raw
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccaccctgtctgcatctggtcggagacagagtcaccatcacgttcggccggccagtcagagtgttcggtacctgggttcggcctggtatcagcaagaaaccgagggaaacgcccctaagcctacctgtactctagtcgatcgtcctacctaagtagtagggtaaacggtcgggtcctagtcgaacggttcgacggtcggactaggtcgagtcggtaggacagtattcctactctaccactatcagcacgtaccctagacgtcctagtagtagttagtttacgngttaactttnttacgtcgacctaagtaacgttaagttaagtacgtttacttaccgttacgtttcccggaaccgttacggactagtggagtaatacgtaactaaacggtagtccggtagccgtacgaccgtaccgttattccgtacgttaccttcccg

SEQ ID NO: 167818 - DNA, 757 bp, Homo sapiens
  misc_feature: GYAE6OF02GUHOM.16.81.H04.1.454.CMB.1.raw
  modified_base (284)..(284): a, c, t, g, unknown or other
  misc_feature (284)..(284): n is a, c, g, or t
tcagtgtactactccacgaccggtgctcgatttagtagtgtagattcgcgggggtcagactcagtcaggacacagcatggacatgacgggtccccgctcagctcctggggctcctgctgctctggctcccaggtactcaaatgtgacatccagatcggacccagtcctccttccacccttgtctgctattcgtgtacggagacgagacgtaccacatctacgttcggcccgggacctagtcgaggtaggttggttcggtaccgtgggttcggccttgggttacncgtacgcaaaggtaaaccgaagggggaaacctacccccgtaaagtcccgtacctggtaacttctagttacgtactttccggtacctaaccgtaagtacgttaagggaaacgggttccggggtaccctaacgttaccggttaaaggttcgtaacggccggtacggtaggtcggtaacgttcgggacggggtaactaaggtaaccgtttaccaccgttacccgtacccgtaactacgtaacaccggtacacccgtaacctacgtaccgtacgttacgtaagttacgtttagttttccggacgttttacctttagtttacgtaccgtaaccgtaagtaaacgtttaaggttaaacgttagtttaacgtttaccgttaaccgtttccgggaccgttacgtaaacccgtgtacggttagaacttacgtaacgaaccgtacgttgagtcgtcgacctcgtacgttctcgttacttaccg

SEQ ID NO: 167819 - DNA, 699 bp, Homo sapiens
  misc_feature: GYAE6OF02IX4YX.16.81.H04.1.454.CMB.1.raw
  modified_base (142)..(142): a, c, t, g, unknown or other
  misc_feature (142)..(142): n is a, c, g, or t
  modified_base (662)..(662): a, c, t, g, unknown or other
  misc_feature (662)..(662): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctccaggtatcaaatgnacatccagatcgaccagtcctccttccaccctgtctgcattctggtacgagacaggactacactatcgtacgttcggccggtactagtctaggtacggttcgttacggtaccgttgggttcggtccgttaggtactaccgaacgtaccgaaacggaaaaccggaacggggtaaaccctacccccgtaaggtcccttaccgtaggtaacctttcgtaagtacgtagtcgtacctacgtagtaggtaacgggtaacgtcggtacctagtacggtacgtcgaggtccgagtaggcggtacttcggaggaactaacgtacttccgtacgtaccgtacactacgtaccgacgtaccaccgtaccacgtaccgtacgtagttaccgttagttacgttacggttactttactttaacgttctaaccgtaactaacgtaagttactaagttaccgttacttacgtaccgttcgaaccggtacacgttagtcggttactagtacgtaacggtaaccgtgtacgtaccgngttacgtacctaattccggttcttacgtccttaaccg

SEQ ID NO: 167820 - DNA, 716 bp, Homo sapiens
  misc_feature: GYAE6OF02GH36A.16.81.H04.1.454.CMB.1.raw
tcagtgtactactccacgaccggtgctcgatttagtagtgtagattcgcgggggagtcagactcagtcaggacacagcatggacatgagggtccccgctcagctccgtggggctcctgctgctctggcctcccaggtatcaaatgtgacatccagatcgacccagtcctccttcccacccgtgtctgctatcgtggtccggagaccagactcacctatccacgttcggcccgggccagtcaggtagttggttcggtaccgtggttcggcgtggtatccgagacgaacgaaaccgagggaaaccgcccgtaagcctccgtagtacttcctagtagtacgtcgtacctaccaaagttagtaagggtaacggttccgggtaccctatcggtaacggttaccgaagggccggtacgaggtggtacgtacggtaggaactaagttaacgttccaccgttccaaccctaccgtactcgaacgacctacgtacccgtacgacgtaccttggtaacttcgttactttcggaacctttattacgtttacgtaccgtaccgtaaagtagttaaacgttaacggttaacttttaacgttacccgtttaacgttccccggtccgtaaacgggtaacccttagttacggtacgttaagtaacggttaaaccgacgttaacgttacggtcgtaccgtcgaaccgttaccttacgttcctacgtttaaccc

SEQ ID NO: 167821 - DNA, 699 bp, Homo sapiens
  misc_feature: GYAE6OF02H4HBQ.16.81.H04.1.454.CMB.1.raw
  modified_base (185)..(185): a, c, t, g, unknown or other
  misc_feature (185)..(185): n is a, c, g, or t
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (676)..(676): a, c, t, g, unknown or other
  misc_feature (676)..(676): n is a, c, g, or t
tcagtgtactactccacgaccggtgctcgatttagtagtgtagattcgcgggggtcagactcagtcaggacacagcatggacatgagggtccccgctcagcctccgtggggctcctgctgctctggcctccaggtatacaatgtagacatccagatcgacccagtcctccttccaccctgtctgnactctggtacggagacagactccaccatctacgttcggaccgggcagtacnggtagtcggttggtaccgtgggttcggaccttggataccgaagccaaacgaaaccgaaggggtaaaccnccccgtaagtccgtaccgtgaccttntaacagtctacgtcctaacagtaaggtaggaaggtccgggtaccagtcgtaagtacgagcgtagagtcgacttggacggaactagtaactcctacgttacccactaaccgctacgcgtaccgtacgacctaccgccgttaccgtagtgttacgttacgttttacgacgttttaaccttaattttaccgtaacgtaccgtaaagtaaaggtttaaataaacgggtttaactttaaccgtttaaccgttacccgtttaccgggacccgtaacggtaacctaggtacgtacgtaactacgtaaacgtaaccggttagttggtacgtaccgttacgaccgtaaccgttntttccgttagttacccttaaccg

SEQ ID NO: 167822 - DNA, 654 bp, Homo sapiens
  misc_feature: GYAE6OF02F6MBB.16.81.H04.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (431)..(431): a, c, t, g, unknown or other
  misc_feature (431)..(431): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccaccctgtctgcatctgtcgganacagacgtcaccatcacttcggccggccagtcagngtgttgtaccgtggttgcctggtatcagcaagaaaccgaggaaacgccccgtaagcctcctagactactatagattcgtacctactaagttaaggtgggtaaaacggttccggggtacccctaagttaccgtaaacgggtttacgacggccggtagtacggtggtacgtcggtagggaactaagtaacttcactcctaccacnctacacgaccacgacctacgacgtccgtagtacttggttacgtttacgtacgttaactttagttacgttacgtaaccctaaagtaagttaacgtaaagttacgtttacttaccgttaacccgtttccggtacccgtaggtaaaccgtagttacggtagtaactaacgtaacgtaaaccgtacgtcggtacgtcgttcgaccacgttatcttacgtccttaccg

SEQ ID NO: 167823 - DNA, 815 bp, Homo sapiens
  misc_feature: GYAE6OF02FOUT7.16.81.H04.1.454.CMB.1.raw
  modified_base (220)..(220): a, c, t, g, unknown or other
  misc_feature (220)..(220): n is a, c, g, or t
  modified_base (778)..(778): a, c, t, g, unknown or other
  misc_feature (778)..(778): n is a, c, g, or t
tcagtgtactactccacgaccggtgctcgatttagtagtgtagattcgcgggggtcagactcagtcaggacacagcatggacatgagggtccccgctcagctcctggggctcctgctgctcgtggctcccaggtatcaaatgtgacatccagtatcgaacccagttcctccttacccgacccttgtctagctatccgtgtacggagacaggagtcaaccntacacgttcggccgggcagtcgaggtgtggttacggtaccgttggttcggtccgtaggtactcgaaggtacgaaacggaaaccgaacggggaaaccgtacccccgtaaagtccccgtaccgtagaacgttaccgttagtacgtaacgttcgtacctaaccgtaagtagggtacgggtaaaaccgggttcggggtaaccccaggttaaccggtaaacgggttccgtaacggtacggtcggtaacgggtacggtacgtcgggttaacgggaacttaacggtaactttacccggacctttacccgtaacgtaccaacgttccgaaccgtacctaaccggtacccctaacgggtaaccgttacccgttaggtaccgttttacggttaccttttaaggttaaccggtttaacctttagtttaaacccgttccgtaaacctaaagggttaactttaaaggtacgtttaacgttttaaccgttaaccgttaccgttaacccggtaccgttaacggaaacgttacgtacggttagaacttaacggacgtaaacggtacgttacggngtaccgatcctaacgtcgtttccgtatacccgttacc

SEQ ID NO: 167824 - DNA, 684 bp, Homo sapiens
  misc_feature: GYAE6OF02IFAXD.16.81.H04.1.454.CMB.1.raw
  modified_base (200)..(200): a, c, t, g, unknown or other
  misc_feature (200)..(200): n is a, c, g, or t
tcagtgtactactccacgaccggtgctcgatttagtagtgtagattcgcgggggtcggactcagtcaggacacagcatggacatgagggtcccccgctcagctcctggggctcctgctgctctggcctcccaggtatcaaatgtgacatccagatgacccagtcctccttccaccctgtctgcatctgtacggagacagngtcaccatcacttggccggcctagtcagtaggtgttcgtacgtggttcggctggtatcgagcaacgaaaccgaggaacgaccctaaggtcctccgtagtaagtcctagttagattcgtacctaaccgtatagtacggtaacggttcgggtacctagtacgtaacggttccgaggaccgtacgtaggtaggtagtggtaacgggacgaacgttacgttaccgacttccgtaccgacctacgtacaacgacgtaccgacgtacaccgtcgtagtacgttagttagtttacgatttacgtttaacgttcttaacgtaaccgtaaataacgttaagtaacgtttacgttaacgtttaccgttaaccggtttacccggtaccgttaacgggtaaccttaggtacgtacggttataacgtaacgaaacggtctacggttacgacgtttcgaaccgtacgtaccgttagttccgttacccttacttacccg

SEQ ID NO: 167825 - DNA, 707 bp, Homo sapiens
  misc_feature: GYAE6OF02GZ4TS.16.81.H04.1.454.CMB.1.raw
  modified_base (196)..(196): a, c, t, g, unknown or other
  misc_feature (196)..(196): n is a, c, g, or t
  modified_base (276)..(276): a, c, t, g, unknown or other
  misc_feature (276)..(276): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatacaaatgtgacatccagatgaccctagtccttccttccacctgtctgcattcgtgtcgganacgagtacgtccaactatcctacgttcggacccgggcctaggtcaggtacgttggttacggtaccttggtcgcctggtancagacgaagaaccgaggaacgtacctagctactagtactctagtgtactcgtacctacctaagtacgtaggtaacggtcgggtaccagtacgtacggtcgacggtcgactaggtcgtacgtcggtaggactaagtacgttaccacgtacctacgtaacctacgtacgaacgtaccaacggttaccctacgtacggtcgtacgtagttacggtttacgttttacgacgttttacgtttacgtttacgtacgtacctaagttaacgttaagtaacggtttacgtttaacctttacggttaacccgtttccgggaacccgtacggtaacgtaacgttacgggtagtaaccttaacggaaaccgtaaaccggttacgttgggtacccttacggtaactccgtaaacccgttgttacggttccttaccgtttcccg

SEQ ID NO: 167826 - DNA, 680 bp, Homo sapiens
  misc_feature: GYAE6OF02FX9VW.16.81.H04.1.454.CMB.1.raw
  modified_base (200)..(200): a, c, t, g, unknown or other
  misc_feature (200)..(200): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaagtgtgacatccagactgacccagtcctccttccaccctgtctgcatctggtcggagacagngtcacatcacttgcccgggccagtcaggtagttgttcggtaccgtgggtcgtccgtggtactacgacgcaaggaaaccgagggaaacgcccctaagcctacctgatacgtatagatcgtacctacctaagtagtagggaacggtcgggtaacctagtacgtacgggttacacggcggacgtaggtcggacgtacggtacggggacctaaagtacgtttaccaccgttccgtacccaactacgttaccgaacggaccacgtacccgtactaccgtcgttacgatttcggttacgttttagaccgtttactttaactttacgttaccgtaacctaacgttaaagttaagtaacggttacgttaacttacggttaaccgtttacccgggtaccgtacggtaaccgtaggttcgtagtactaacgtaacgtaaaccgtactggtaccggtataccgactaccgttacgtcttacgttactaccg

SEQ ID NO: 167827 - DNA, 701 bp, Homo sapiens
  misc_feature: GYAE6OF02HEE8V.16.81.H04.1.454.CMB.1.raw
  modified_base (205)..(205): a, c, t, g, unknown or other
  misc_feature (205)..(205): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctcccaggtatcaaatgtgacatccagatgacccagtctccttccaccctgtctgctatctggtcggagacagagtcaccntcacttgccggcagtcagagtgtggtacctggttcgcctggtatcagcaagaaacaggaacgcccctaagctacctgtactacgtatgtatcgtcctaccaagttagtacgggtaaacgggtcggggtaccctaagttacgtaacggttaccgaggaccgggactagggttgggaacgtccggtaggggaactaaggttaacctttaccgtaccttaccgttacccgaaccttagtaccgtaaccgtaccgaacgtacccctaacgaccggtcctagtaacgttaggtttaacgttttcgaaccggtttaacgttttaatttaacgttaccgaaccctaaacgtagttaaagtaaccggttaaggttttacttaccgttaacggttttccccgggaacccgttacgggtaaaccttaggttacgtacggttatacgtaacgtaaacgacgttcgggagtccgtagacctaccgtagttcgttacgtacttcctacg

SEQ ID NO: 167828 - DNA, 840 bp, Homo sapiens
  misc_feature: GYAE6OF02I7C9I.16.81.H04.1.454.CMB.1.raw
  modified_base (197)..(197): a, c, t, g, unknown or other
  misc_feature (197)..(197): n is a, c, g, or t
tcagtgtactactccacgaccggtgctcgatttagtagtgtagattcgcggggggttcgagactcacgtcaggacacagcatggacatgagggtccccgctcagctcctggggctcctgctgctctggctcccaggtatcaaattgtgacatccagatacgaccagtctccttccaccctgtctgcatctgtcgganacagagtcaccgatcacttcggcccggctagtcaggtagtggttcggtaccgttggttggccgttggtactcagacaaggaaaccgaagggaacgaccccgtaacgcctccgtagacttactagtgacgttcgtaccttaccgaagttaagtagggtaaaggttcggggtaccctaagtaacgtaacggttacgtaacggacggtaccgtagggttacggaacgttacggtagggaaaccgtaaggtaaacttacccgtaaccttaccgtaccctaacctaagtacccgaaacgggtaccgtaaccgtaaccctaaccgtaccgtaaccgttaagtacgtttaacgttaacgttttaccggaaacctttaacgttttaacttttaaccggtaccgtaaccctaaagttaaacggtttaataaaccggtttttaaacgtttaaaccttaccggtttaaacccgtttttacccggggacccgttaaaccggggttaacttaaaccgggttacgggtttacgtaaacgtttacccgttaaaaccgggttaaaaaccgttacggtttaggggtttaacccggaccgttttaccgtaaaccccgaaccgtttaaccggtccggttttaaccgtttacctttaccccgg

SEQ ID NO: 167829 - DNA, 706 bp, Homo sapiens
  misc_feature: GYAE6OF02JRDCB.16.81.H04.1.454.CMB.1.raw
  modified_base (144)..(144): a, c, t, g, unknown or other
  misc_feature (144)..(144): n is a, c, g, or t
  modified_base (163)..(163): a, c, t, g, unknown or other
  misc_feature (163)..(163): n is a, c, g, or t
  modified_base (352)..(352): a, c, t, g, unknown or other
  misc_feature (352)..(352): n is a, c, g, or t
  modified_base (485)..(485): a, c, t, g, unknown or other
  misc_feature (485)..(485): n is a, c, g, or t
  modified_base (514)..(514): a, c, t, g, unknown or other
  misc_feature (514)..(514): n is a, c, g, or t
tcagtgtactactccacgaccggtgctcgatttagtagtgtagattcgcgggggtcagactcagtcaggacacagcatggacatgaggtccccgctcagctcctggggctcctgctgctctggctcccaggtatacaaatgtanacatccgagactcgaaccngtcctccttccacctgtactgcatcgtcgtcggacaccaggacgtccacactctacgttcggccggtccagtcgagtacgtgttacggtcgtggtgccgttaggtactcgtaacggacgaaaccggaaaccggtaacggggtaaaccctcccggtaacgtcccgttaccgtagtaacgtccgtttaagngttacttaccggtacctaaccgtaaagttggtaaccgggaacggttccgggtaccttaaggtacgttaacgtcgaggccgtacgtaggtagtacgtacggcggattaaggtcttaaccgtctacgcctacgtntaccgactacgcgttccaacgcgttacgngttaacgtagttacgttcttacgttaacttgttaaaccgtcgaaaccttagtaaacgttattaagttaccgtttaacttacccggttacggttacccggtaccgtaggttaaaccctgttacggtactacgttaccgaacgttacgtagttcgcgttacgtacccgactctacgtttagtccttccgtaacc

SEQ ID NO: 167830 - DNA, 860 bp, Homo sapiens
  misc_feature: GYAE6OF02J1IHO.16.81.H04.1.454.CMB.1.raw
  modified_base (852)..(852): a, c, t, g, unknown or other
  misc_feature (852)..(852): n is a, c, g, or t
tcagtgtactactccacgaccggtgctcgatttagtagtgtagattcgcgggggtcagactcagtcaggacacagcatggacatgacgggtccccgctcagctccgtggggctcctgctgctctggctccaggtatcaaagtgtgacactccagatcgacccagtcctcccttcccgacccttgtctgacctcttcgtacgtacggagacgtagtaccgtaccaacctacttaccgtaccgttccggaccccgggtactaacggtacgtaacggtacggttcgggtttacgggttacccggttgggttaccggtacccgttaggtacctccggaaggtacccgaaaacggaaaaccggaacgggaaccctacccgtaacgtcccgttccgtacgtactcgttaagttccgtacgttccgtttacccaacttaacgggtacggttaacgggacggtttacccgggtaaccctacgtacgttacgggtacccgtaggaccgggttaacgtagggtacgttaacgtacgggttaaccggaagttaccttacttaccgtacccttaccgacctaaacgtcaccgtaaccggccgttaacccggtaacccgtcggtaaccgtcgttaggttaaccgtttacgttaacggttccggtttaaacttttacggttaaccgtttacgaaccgtttaacctacgggtttaaaacgttacggttaaaccgtttacccgtttaaaactttccccgggtaaccggttccccggttaacgaacgggttaacctacgggttactaggtaaccgttaaccgaacggttacgtcgtacgtacgtcggtacctagccttagtcctttacncgttaccc

SEQ ID NO: 167831 - DNA, 695 bp, Homo sapiens
  misc_feature: GYAE6OF02GMHUC.16.81.H04.1.454.CMB.1.raw
  modified_base (307)..(307): a, c, t, g, unknown or other
  misc_feature (307)..(307): n is a, c, g, or t
  modified_base (454)..(454): a, c, t, g, unknown or other
  misc_feature (454)..(454): n is a, c, g, or t
tcagtgtactactccacgaccggtgctcgatttagtagtgtagattcgcgggggtcggactcagtcaggacacagcatggacatgatcggtccccgctcagctccgtggggctcctgctgctctggctcccgaggtatcaaatgtgacatccagatcgacccagttcctcccttcccaccctgtctgcatcgtgtcggagacagtacgtccaacactcacgttcggcccggcagtcgagtggttgttacggtaccgttgggttcgaccgttggtactcgacgaccaaggaaaccgaaggggtaaccncccgtaagcctacctagacttcgtatagacgttcgtactaccgtaagttacggaggtaacggtcggtaccagtacgtaacggtcgacggcggacgtaggtacggagttaccggaggtaactagtaactttcacctcctaccaacgtntaaccgacgccgtaacacccgtcaacgtcgttactagtttcgtaagtttccgaacgtttacctttaagttccacgtaaccgtaaacgtaagttaagttaacgttaccttttacgtttaaccgttaaccggttccgtaccgtaacggttaccttaagggttctaacggttactaacggtaaactaacggtacgttcgggtacacgttccgaaccctacgttacgtacttacgttccgttacg

SEQ ID NO: 167832 - DNA, 739 bp, Homo sapiens
  misc_feature: GYAE6OF02HR7NP.16.81.H04.1.454.CMB.1.raw
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
tcagtgtactactccacgaccggtgctcgatttagtagtgtagattcgcgggggtcagactcagtcaggacacagaatggacatgagggtccccgctcagctccgtggggctcctgctgctctggctccaggtatacaaatgtgacatccgagactcgacccagtcctccttccacctgtctgctatctggtcggagacagntacaccatctacgtcgaccggcagtacagagttgttacggtaccgttgggttcggccgttaggttacncgacgacgaaacggtaaaccggacgggaaaccgaccccgtaacggtccttccgtagacgttctaagtcgtacttcgtacctacgtaagtaacgtagggtaaacggtcgggtacctaaggtacgaacggttacgacggtccggaacgtgggtacggtacgtcggtacggtaacgtaacgttacttactaccgttctacctacgactacgacggtaccaaccggttaccctagtaccggtcgttagtaacgttacgtttagttccggacgtttaacttttagttacgtttaccggaactaaacgttaagttaagtttaacggttaacgtttaaaccctttacgtttaacccggtttcccgggaaccgtttaacgggaccttaagttacgttagtacgttaacttaaccgaacttaccgggtggtacgtaccgcgttaccgacttcgttaggtacctttccgtaccttaacc

SEQ ID NO: 167833 - DNA, 772 bp, Homo sapiens
  misc_feature: GYAE6OF02GTX24.16.81.H04.1.454.CMB.1.raw
tcagtgtactactccacgaccggtgctcgatttagtagtgtagattcgcgggggagtcagactcagtcaggacacagcatggacatgagggtccccgctcagctcctggggctcctgctgctctggctcccaggtatcaaatgtagacatccagatcgacccagtcctcccttccaccctgtctgctatctgtacggagacagagtcaccatctacgttcggcccgggaccagtcaggtcggttgttcggtaccttgggttcggccgttggtatcgagacaaggaaaccgaagggaaaccgtccccgtaagtccgttccgtaggtacttactagtacgtacttcgtacctacctaaagtaggtaacgggtaaacgggtccgggtaccctaagttacgtaacggttacagggcggtgtaggtaggtcgtaggtacggaactaaggtaacttaccgtaaccttaccgtaaccctaacctaccgttaacgaccgtaccgtaacggaccccttaacgaccgttcgtagtaaccgtttgtttaacgttttaccggtaactttaactttaagtttaccgtaaccgtaaacgttaacgtaaaggttaaacgtttaaacgttacgtttaaacttacccggtttaacccgtttaccgggtacccgttaacgggtaaccgtaagttacggtaacggttaacgtaaacgtaacgtaaaaccggttaccgttacggttacggtaacgttaccgaacccttacgtacgtttaccgttcttacccg

SEQ ID NO: 167834 - DNA, 750 bp, Homo sapiens
  misc_feature: GYAE6OF02GO1UL.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctccttccaccctgtctgcatcgtgtcggagacagagtccaccatcctacgttcggcccggcagtcagtagttcggttcggtaccgtggggttcggccgttggtactcgagtacgaacgaaaccgaacgggaaaccaccccgtaagtcccttaccgtagtactactagtcgacgttcgtacctaacgtaagtacgtaagggtaaacgggttccgggtacccctaaggtacgtaacggtcgaacggcggactagggtcggtacgtacggacgggtaactaacgttaactaccgtacttacctaccctaaccgtactacgacgtaccgtacgtaccccgtaacaccggtctacggtatttaccggttacgtttacgactttaacgtttagttacgtacctaaccgtaaacgtaagttaacgttaagttaccgtttaacgtttcccgttaacccggtttcccggacccggttaaacggtaaccttaagggttacggtacgttacgtaaccgttaaccggtaaacgttaccggtacggtaccggtacctacggacccgttacccgttagttaccggttcttacccgttacc

SEQ ID NO: 167835 - DNA, 913 bp, Homo sapiens
  misc_feature: GYAE6OF02IOOF7.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctccaggtatcaaatgtgacatccagatgacccagtctccttccacctgtctgcatctgtcggacgacagtagtcaccatcctaccgttcggccggcctagtcgagtagtcgttcggtaccgttggttcggccgttggtactcgagaccgtaaacgaaaccggaagggaaaccgtacccccgtaaaggtcccgtaccgttcggtaacttaccgtaagttcggtaacttcggtaccttaacaaagttaacggtaacgggtaaaacgggttccgggttaacccctaacggttacggtaaacgggttaccgtacggtaccggtaacgtacgggtacgggtaccgttacgggtaacgggtaaacgtaacgtaaacctttacgtaacccgttaccctaaccgtaaccctaacgtaccgaaccgtaacccgtaaccggtacccctaaccgaccggttaaccgtacggttaactttcggttaacgttttacggtaacctttaaccgtttaagttttaccgttaaccgtaaacccgtaaaccggtttaagttaaaaccggttaaacggttttaaccgtttaacgtttaaacccggttaaccccgggtttttacccgggaaacccccggtttaaagggtaaaccccgtttaacggtttaaccgggttaacggttaaaaccgttaaccgttaaaacccgggttaaaaccggttccggttaacgggttaaccgtaccggttaccgggtaacccttaacccggttacgtttacccggttacggtttaccctttaaccccgg

SEQ ID NO: 167836 - DNA, 655 bp, Homo sapiens
  misc_feature: GYAE6OF02F0OVI.16.81.H04.1.454.CMB.1.raw
  modified_base (429)..(429): a, c, t, g, unknown or other
  misc_feature (429)..(429): n is a, c, g, or t
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatgaccccagttctccttccaccctgtctgcatctgtcggagacagatcaccatcacttcggccggcctagtcagagttgtcggtacctggttcggcctaggtatcacggactaacgaaaaccggagggaaacgcccctaaggccttaccgtgactcgtatgattcgacctacaatagtaggaaacgtcgggtaccatcgtaaggtcaggcggtacaggtggtaactggacgggactaaggtaacttccgtactacctacgaacccttataccgaanacgaacgtcctaacgcgtacgtacgtaagttctagttttcgacgttactttagttacgtacgtaactaaactagttaaacgaagttacgtttaagtttaccgttaacgtttccgggtacccgtaacggtaacccgtaagttaggtacgtagttaaccgtaaacggtaacgttaaccgtgtaccgggtacttacggaaccctaacttacttcgtaccgttattcccg

SEQ ID NO: 167837 - DNA, 700 bp, Homo sapiens
  misc_feature: GYAE6OF02GXK66.16.81.H04.1.454.CMB.1.raw
  modified_base (195)..(195): a, c, t, g, unknown or other
  misc_feature (195)..(195): n is a, c, g, or t
  modified_base (542)..(542): a, c, t, g, unknown or other
  misc_feature (542)..(542): n is a, c, g, or t
  modified_base (657)..(657): a, c, t, g, unknown or other
  misc_feature (657)..(657): n is a, c, g, or t
tcagtgtactactccacgaccggtgctcgatttagtagtgtagattcgcgggggtcagactcagtcaggacacagcatggacatgagggtccccgctcagctcctggggctcctgctgctctgctcccaggtatcaaatgtgacatccagatcgaccctagtccttccttcccacctgtctgctatctgtcgganacagagtcactagtcctacttcggcccgggtaccagttccaaggtaggttcggttcggtaccgttgggttcggccgttggtactcgagtacgaacgaaaaccggtagggaaaccgcccgttaacgtcccgttaccgtacgtaacgttccgttagttacgtacttcgttaccctaaccaacgttaggtaagggtaaacgggttccgggtaccccttagtaacgtaacggtttacgaaccggtggtacgtaggttacggtaacgtcggtaacgggacctaagtaaccgttctaacgtcccttaaccgactacgtacgtacacgtaacacccgttacggactcgtaagtnttacgtacgttggtacttacgtttactaacgtccgtactaaactaaggtataacgtttataacttcgtacgttccggtacctagggtactagcgttagctaacggtaaccgtaanaggtcgtacgtaccgtacgcctacttacgtctacgttacctac

SEQ ID NO: 167838 - DNA, 669 bp, Homo sapiens
  misc_feature: GYAE6OF02FJE9I.16.81.H04.1.454.CMB.1.raw
  modified_base (96)..(96): a, c, t, g, unknown or other
  misc_feature (96)..(96): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (292)..(292): a, c, t, g, unknown or other
  misc_feature (292)..(292): n is a, c, g, or t
tcagtgtactactccacgaccggtgctcgatttagtagtgtagattcgcgggggtcggactcagtcaggacacagcatggacatgagggtccccgntcagctcctggggctcctgctgctctggctcccaggtatcaaatgtgacatccagatcgaccagtctccttccacctgtctgcatctgtcgganacagngtcaccatcacttgccgggcctagctagagttgttcggtaacctgggttacgcctggtanctaggactagaaaccaggaacgccctaagctccgtanagttctatagactgtacacaaattagtcggaaggtcggtccatacgtaaggtcagtcgagtcgtgactcgtaggaactaaagtctactactaccgtacaactaacgtacgtacgcgtaccgttacacgtccgactagttacggtaactttacggtacgtaaccgtttatttaacgttactacgtaaaccgtaagttaacgtaagttaaagttaaccgtttaacgttaaccgttaaaccggtttcccgttaacggaaccgtttaaacgtaaagttgtaaccgttacgtaaattaaaccccgtaaggtcggttaaggtcccgttaacggtacctaaccgtaccggttactaaccggtttctacctttaacggttacccc

SEQ ID NO: 167839 - DNA, 770 bp, Homo sapiens
  misc_feature: GYAE6OF02GMFNH.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaagtgtgacatccagatcgacccagtcctccttccgaccctgtctgcatcgtgtcggagacagacgtcacatcacgtcggcccggcacgtcgagtagttggttcggtaccgttgggtcggtccgtggttatcgtacgacaaacggtaaaccggaacgggtaaacccgtacccctaaggcccttcgtacgtacgttacgtagtcgtattccggtacctactaagtaggtaaggtaacgggtccgggtaccctaagtacggtacggtaccgcggcggagtaggttggacgtcggtaaggaaccgtaacggttaacttaccgtacctacctaccgtaacgtacgtaaccgaaccggtaccaaccggttaccctaacgacccgtaccgttaggttaccgtttcggttttaacgtttaccgttaacggtttaactttaaacgggtttacctaacggtaaacccgtaaagtttaaacggttaacgttaacggtttaacgtttacgtttaaccgtttaaccgttccgggtaccgtacggttaaaccgtacggttaggtacctaagttaacgtaaccgtaaacggttcgtacggtacggtaccgtacgtacctaccgttagttccgttacgttcttacccg

SEQ ID NO: 167840 - DNA, 681 bp, Homo sapiens
  misc_feature: GYAE6OF02FT7WI.16.81.H04.1.454.CMB.1.raw
  modified_base (191)..(191): a, c, t, g, unknown or other
  misc_feature (191)..(191): n is a, c, g, or t
  modified_base (459)..(459): a, c, t, g, unknown or other
  misc_feature (459)..(459): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagatcaccatcacttcgccggcagtcagtgttgttcggtactggttggccgtggttactcgaacgacgaagaaaccgaacggggaaaccgacccctaacggccttcccgtagtacttcttagtcgtatcgttcctactaacgttagtagggtaaaggttccggggtacccaacgtaccgtaacggttccgacggtccggcgtagtaggacgtcggtagggaactaagtaacttacacctcctctaacctactacgagaccgtaacnccttaaccagtcctaggtacttcgtagtttcgactacgttttacttacgtccgacctaagtaagttaagttaacgtacgttttactaaccgtttaccgttaccgcccgttaacgggtaaccctaagtttcgtaccgtaattaaccggttaaaccaaaccggttacgttaacgggttacgaccgttacggaccttaacctcgtcgtttaccgttctttacccg

SEQ ID NO: 167841 - DNA, 798 bp, Homo sapiens
  misc_feature: GYAE6OF02GF1VQ.16.81.H04.1.454.CMB.1.raw
tcagtgtactactccacgaccggtgctcgatttagtagtgtagattcgcgggggtcagactcagtcaggacacagcatggacatgagggtccccgctcagctccgtggggctcctgctgctctggctcccaggtatcaaatgtacgactatccagactcgaccagttctccttccaccctgtctcgacattcgtgtcggagacagacgtacaccactctacgttcggccggactacgctaggtagttggttacgtaccgtggttacggcgttcggtatcgagtacgaacgtaaaacggaaggaaccgaccccgttaagccttaccgtacgtacttaccgtagctacgttcgtactaccgtaaagtaggtaacgggtaacggttccgggtaccgtaagtaccggttaaacggtccgtacgggtacgacgggttaacgtgggttaaactcccgggtaaggtaaccgtaagtaaccgtttacccgaaccgttcctaaccacccggttacgcgtaaccgcgtaaccggtaccctacgtaccgttaccgttaggttacggttacgttacggttttacgtaaggtttaaaccctttttgttaaacctttccggaaacttaaccggttaaaggttaaattaacggttttaaacgtttaccgtttaaccgtttaaccccggttttaccgggaaccgttaacccgggttaactacggttttacgggtactaacgttaaacgtaaccgttaacaacggtttacgcgtaacggcttaaccctgtacggtttacctacgtttccctacgg

SEQ ID NO: 167842 - DNA, 942 bp, Homo sapiens
  misc_feature: GYAE6OF02FXHIN.16.81.H04.1.454.CMB.1.raw
  modified_base (197)..(197): a, c, t, g, unknown or other
  misc_feature (197)..(197): n is a, c, g, or t
tcagtgtactactccacgaccggtgctcgatttagtagtgtagattcgcgggggtcagactcagtcaggacacagcatggacatgagggtcccgctcagctcctggggctcctgctgcctctcggctcccaggtatcaaatgtgacatccagagtgaacccagtctccgttccaccctgtctgcatcgtcgtcgganacgagacgtaccaacctactaccgaagttccgggacccgggtccgaacggttcgtaaggtaacgggtttcggttaccgggggttacccgttgggttccggggtcccttaggggttaccttcgaacgtaccggaacgaaaaccggaacgggggtaaaaccggtacccccggttaaacgtacccgtaccgtacgtacgtacgttaagtacggtagttaccggttacctaccgtaaaactaacggtaacgggtaaacggtttacgggggtccctaaacttaccggaacgggttttaccgaccggtccggacgtaagtcggtaacgtaccggtaggaacgaacgtaattccgtaaggtacctacaccgtacgtacggtaactaaccgacgtaaccctacgtacggtaccgtacgtaacgttacggttacgtttacgtaagtttaaccgttttaaacgttaacggttaaccgtacctaaaaccggtaaacgtttaaaacgggtaaccgttttaaacgggttttaacttttaaaccggttaaaccggttttacccgggtaaacccgggtttaaaccgggttaaaccccgtaagggtttaccggtaacgggttaaacccgtttaaaccggttaaaacccggtaaaacggtaaccggtttacggttaaacccggtacggtttaacccggtcccgttaaaaacccgggttacctttaccgttttaacccccggttaccggttttaaaccccccg

SEQ ID NO: 167843 - DNA, 670 bp, Homo sapiens
  misc_feature: GYAE6OF02FNVPX.16.81.H04.1.454.CMB.1.raw
  modified_base (252)..(252): a, c, t, g, unknown or other
  misc_feature (252)..(252): n is a, c, g, or t
  modified_base (519)..(519): a, c, t, g, unknown or other
  misc_feature (519)..(519): n is a, c, g, or t
tcagtgtactactccacgaccggtgctcgatttagtagtgtagattcgcgggggtcagactcagtcaggacacagcatggacatgagggtccccgctcagctctggggctcctgctgctctggctcccaggtatcaaatgtgacatccagatgacccagtctccttccaccctgtctgcatctgtcggagacagagtcaccatcacttgcccgggcagtcagagttgttcggtactggtgcctggtatcagnaacgaaccgagggaacgacccgtaagcctcgtaggactcgttagtgtaattcgtactaccgtaattaaggtacgggaaacggttcggggtaaccctagtacgtaacggttcgaacgtccggagaggtcggtagtccggttaggggactaggtaaacttctaacgttctaccgaacctatacgtaacggctaacgtaccctaacgtaccgaccgtgtaactcggttatttacgggaccgttactttaacgttactacgtaccgtaaanacgtttaaataaaggttactttaacgtttaccgtaactttccggtacccgtacgggtaacctagttacggtagtaaccgttataaccggtaaaccgtacgtacggtacggagttaccgtaccctacggttacctacgttcgttacgtaccc

SEQ ID NO: 167844 - DNA, 632 bp, Homo sapiens
  misc_feature: GYAE6OF02HY9RD.16.81.H04.1.454.CMB.1.raw
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagtgtactactccacgaccggtgctcgatttagtagtgtagattcgcgggggtcagactcagtcaggacacagcatggacatgagggtccccgctcagctccgtggggctcctgctgctctggctccaggtatcaaatgtgacatccagatcgacctagtctccttccaccctgtctgcatctggtacggagacaggactcacatctacgtcggaccggctaggtacagtaggttcgttaggtaccgttgggtcggtccgtggtatcgagacgaacgaaaccgagggaaaccgacccgtaagtcctacgtagtatcttacgtagagtcgtactaaccaataggtaaggaaacggtcgggtacctacgtacgtaacggttacgacggtacgcgtaggtgacgttcgaaggactaagtaacttacncttacgtacncctatcganacgaccgtactacgacgtcgagtacttgttacttggaacgttaactttagttacgtacgacgtaactaagtaagttaaacgtgtttaattaccggttaccgttacggtaccgtagtaactgtacgtagtaactacgtaactaaacgtgtcggtacgacgtacgccacttacgtacttcctcgtaacc

SEQ ID NO: 167845 - DNA, 617 bp, Homo sapiens
  misc_feature: GYAE6OF02GDM9R.16.81.H04.1.454.CMB.1.raw
  modified_base (282)..(282): a, c, t, g, unknown or other
  misc_feature (282)..(282): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatcgtgtcggagacgagagtcaccatcacttgcccgggcagtcagagttgttcggtaccgtggttcggcctggtactcagacaagaaaccgaggggaaaccncccctaagcctccgtgacttcgtaatgactgtacctacctaatagtgggtaaacgtggggtacccagtcgaaggttcaggcggcaggtgagtcgaggacagtaatcacgtctaccactatcgacgtcaacgtcctaacgacgtcctacggattacggttgtttacggacgttaactttagtttacgttcgtaacctaaacggtagttaacgtaaggtactttaattaccgttaaccgttttccggtacccgtacggtaacctaagttcgtagggtactaacgtaacgaactaacgtcggtagtacgtcaccgtaccgtatacctgtaccttaccg

SEQ ID NO: 167846 - DNA, 698 bp, Homo sapiens
  misc_feature: GYAE6OF02HHVHP.16.81.H04.1.454.CMB.1.raw
  modified_base (451)..(451): a, c, t, g, unknown or other
  misc_feature (451)..(451): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgaccagtctccttccaccctgtctgcatctgtcggagacagagtcaccatcacttggccggcccagtcgagtagtgttggtacctgggttcgccgtggtatcgagacgaacgaaaccggaacgggaaacgacccccgtaagccgtacctagaacttactatgtatcgtctaccgtaataagtaggaaacggttacggggtaccctatacggtaagttcgacgcggacaaggtggattacgagggtacaagtaaacttcactaccacaactataccgtagacctagtaccctaacgacnccgtagtattacggtaactttggaacgtttaaccttaagtttacgttacgaaccgtaaacgtagtaaacttaaaggttaacgtttaacgtttaaccgttaacgttttacccgggtacccggttacggttaaaaccgtacgtaacggttacggtaacgtaaacgttaaccgtaaaacggttaccggttaaggtacggtacgttacggaaccctaaccgttacgttccgttacggttacctttaacccg

SEQ ID NO: 167847 - DNA, 830 bp, Homo sapiens
  misc_feature: GYAE6OF02HOOOC.16.81.H04.1.454.CMB.1.raw
tcagtgtactactccacgaccggtgctcgatttagtagtgtagattcgcggggggtcagactcagtcaggacacagcatggacatgagggtccccgctcagctcctggggctcctgctgctctggctcccaggtatcaaatgtgacatccagatcgacccagtccttcccttcccaccctgtctcgcactctggtcggacgacgacgacgtccaccactactacgttcggccggccacgtcgacggtagttcggtttacggtaccgttcggggttcggtccgttagggtactacgtaggaccgaaacggaaaaccggaagggaaaccgtaccccgtaaacgtcctaccgtcgtaacttacgttaagtacggtagtcgttaccttaccgtaaagttaggttaagggtaaacgggttacgggtaccctaagttacggtaaacggttcgacggtcgtacgtagggtacgtacgttacggtacgggtaactacggtaaacttccgaaccgttccctaaccgacctacgtaacaccggtactacccggtaacctaccgagtaccgtaggttacgttacgtttaggtttacgttaaccggttaacttttaagtttaccgtacgtaaaccttaaacggtaagttaaagtttaaacgtttaccggttttaactttaacccgggtaacccgtttttccggggtacccttaaccggggtaaccgttaacgggttacggtaggtttacgttaaagttaaaccccggtaagttaacccgggtttagggaccgttacggtacctacctaaccgttagtttaccctttagtttcccgttaaccc

SEQ ID NO: 167848 - DNA, 834 bp, Homo sapiens
  misc_feature: GYAE6OF02F3RY4.16.81.H04.1.454.CMB.1.raw
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatcgacccagtcctcctccacctgtctgctactctgtcggagacgagacgtccaccgatcctacgttcggccggtccagtcgagtacgttcggttacggttaccgtgggttcggtccgttggttactcgtaacgacgaaacgaaaccggaaacgggtaaaccgtaccccgtaacggaccttccgtagtacgtacgttagtgtacttcgtacctaaccgtaagttaaggtacgggtaaagggttccggggtaccctaacggttacggtaacggttaccgacggtacggtacgtaacggtaggtacggttacggtacggggtaactaacgtaacgttaacccgtaaccgttaccgtaaccccgtaaccgtaacgtaaccgtaacggtaccctaacggttacccgtaacgtaccgtccgtaaggttaccttacggttacgtttaccggttaacgttaaccgttttacgtttaaccgttaccgtaaccgttaagttaaaccgttaacgtaaagggtttaccttttaaccgttaccgtttaccggttttacccgtacccggttaaaccgtaccgttaacggttacggtttaggtaaccttaaccggtaaacgttaaaccggttaacgttcccggtaggtaacccgttaccgacccttaaccggtcttaccgttaccgttctttacccg

SEQ ID NO: 167849 - DNA, 650 bp, Homo sapiens
  misc_feature: GYAE6OF02JFQY8.16.81.H04.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (348)..(348): a, c, t, g, unknown or other
  misc_feature (348)..(348): n is a, c, g, or t
tcagtgtactactccacgaccggtgctcgatttagtagtgtagattcgcggggtcgagactcagtcaggacacagcatggacatgaggtccccgctcagctcctgggctcctgctgctctggctcccaggtatcaatgtgacatccagatgacccagttcctccttccaccctgtctgcatcctgtcgganacagacgtcacgtatcacgttcgacccggcagtcngtagtgttcgctggtgctgtatnagcagaacgnggaaacctccctaagctactgactcgtatgatcgtacacgtaacgtagtacggaaaggtcgggtaccacgtacgtaaggttcaggccgngacggtagactcgtggaacagtaatacctactaccctctacgtactcaagccgaactaccgtacagcctaggtaactgttacttacgacttacttaattcgtactaaccacgtagttaacgtaacgttaactttacgttaaccgttacgtttacccggtaccgttaacccgggttaactaacgggtttcggttaacgttaactaacccggttttaaaccggaaacccggttaacgttaggtttccggtaaccgttaccggtaaccacccggtttagttaacccgtttgttaacccctttcgg

SEQ ID NO: 167850 - DNA, 709 bp, Homo sapiens
  misc_feature: GYAE6OF02GP0G8.16.81.H04.1.454.CMB.1.raw
  modified_base (191)..(191): a, c, t, g, unknown or other
  misc_feature (191)..(191): n is a, c, g, or t
  modified_base (255)..(255): a, c, t, g, unknown or other
  misc_feature (255)..(255): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcgganacagatcaccatcacttgccgggccaggtcagagttgttggtacctgggttcggcctggtactnagcaagaaaccgagggaaacgcccctaagcctcctagatctatgatcggtctaccaatagtaggaaacggtcgggtaccagtacgtaaggttcaggccggagaggtggacttcggtagggaactaaggtaacttccaacgtttacacctaaccgtacgttacgaacggtcctaaacgtacccgtaacgacggtaccttaggaacgtttcgttaacgtttggtaccgtttaaacttttaacgttacgtttccgtaaccctaaagtacggtttaaagtaaacggttaacggttttaatttacccggttaaacgtttttccccggggaaccctttaaccgggggaaaccttaaggttcgggttaacggtaactttaacggtaaccgtaaaacggttacggtcgggttacggtaaccgtcgaaacctaccgtacctttacgttacggttccttaaccg

SEQ ID NO: 167851 - DNA, 656 bp, Homo sapiens
  misc_feature: GYAE6OF02GPS94.16.81.H04.1.454.CMB.1.raw
tcagtgtactactccacgaccggtgctcgatttagtagtgtagattcgcggggggtcagactcagtcaggacacagcatggacatgagggtccccgctcagctcctgggggctcctgctgctctggctcccaggtatcaaatgtgacatccagatcgacccagtctccttccaccctgtctgcatcgtgtcggagacagagtcacatcacgttggccggcagtcaggagtgttggtacctgggtgcctggtatcgagcaacgaaacgaggaaacgccccaagctacctagatctatgattcgtctactaatgaaggtaaaggtcgggtaccaatacggtaagttcgaggtcgacgtagtgtagtaggtggacaagtacttcgacttcacaactactacgacgtacagtaccctacgacgtacctagacgttgttacgtttaggacctttaagttttactttaacgtacggtaaacctaaacgtaagtttaaacgtaagtttaacgtttaactttacccggttaaaccgtttcccgggtacccgttaaacgggaacgttaacgttcgggttaagtaaccgttaacgtaaaccgaaaggttaccgtaacggttcggactacgtaccgtaacctaccgttactttcggtaccttaaccg

SEQ ID NO: 167852 - DNA, 695 bp, Homo sapiens
  misc_feature: GYAE6OF02F13MO.16.81.H04.1.454.CMB.1.raw
  modified_base (97)..(97): a, c, t, g, unknown or other
  misc_feature (97)..(97): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (423)..(423): a, c, t, g, unknown or other
  misc_feature (423)..(423): n is a, c, g, or t
tcagtgtactactccacgaccggtgctcgatttagtagtgtagattcgcggggggtcggactcagtcaggacacagcatggacatgagggtccccgntcagctcctgggggctcctgctgctctggctccaggtatacaaatgtgacatccagatgaccagtctcctccacctgtctgcatcgtgtcggananagngtcacatcacgtgccggcagtcgagtagtggttggtaccgtggttggccttggtacncagacaagaaaccgaagggaaccncccgtaagcctccgtagtacgtctagtcgtactcgtacctactaaagtaaggtaaggtaaacgggtccgggaccttagtaccgtaagtcgagcgtgaggttacgagttaccgagggtaacagtacttacaccgttcacgaacctanccgaactcggaaactccgtaaacgccgtacttagtacttacggttctttaggtacccttaagttttacttagtacccggaaactaaccgttaaggtaaactttaaaggtacggtttaccttaaccggttaccggtttaccgtaccggttaaaccggtaaccttaaggtaggtacggtttaataaccggttaaacggtaaacgttaccggtaggttacggaccgtaaccgacgttaacctacggtttctacccggtttagacctttaacccgg

SEQ ID NO: 167853 - DNA, 661 bp, Homo sapiens
  misc_feature: GYAE6OF02HBDN6.16.81.H04.1.454.CMB.1.raw
  modified_base (288)..(288): a, c, t, g, unknown or other
  misc_feature (288)..(288): n is a, c, g, or t
  modified_base (654)..(654): a, c, t, g, unknown or other
  misc_feature (654)..(654): n is a, c, g, or t
tcagtgtactactccacgaccggtgctcgatttagtagtgtagattcgcgggggagtcgagactcagtcaggacacagcatggacatgagggtccccgctcagctccgtgggctcctgctgctctggcctcccaggtactcaaatgtcgacatccagatcgaccagtcctccttccaccctgtctgcatcgtgtcggagacagacgtcaccatccacgttgccggcagtcaggtgtggtcgtaccgtggtcgcctggtactcgagacaacggaaaccgacgggaaccncccctaagccctccgtgactctaagtgatcgtcctactaagtagtaggaacggtcgggtaccctagttacgaacggttcgaggccgtggtaggtcgggagttcggtagggaaacctaggtaacttccgtaaccttccgtaacctaacctagtaccctacggaccgtaaccggtacccttacgaccgtccgttagtacgttgtttactttgaccgtttacttttagtaacgtttcgaaccttaagtaaggttaagttaaacggttagtttaaccttaacgttacccgtttccggacccggtacggtactagtcggtaagtaccgttaagaccgtaaactgtcggtagccttacgcctacttccgttntgttccc

SEQ ID NO: 167854 - DNA, 907 bp, Homo sapiens
  misc_feature: GYAE6OF02GXQSK.16.81.H04.1.454.CMB.1.raw
  modified_base (181)..(181): a, c, t, g, unknown or other
  misc_feature (181)..(181): n is a, c, g, or t
tcagtgtactactccacgaccggtgctcgatttagtagtgtagattcgcgggggtcggactcagtcaggacacagcatggacatgagggtccccgctcagctcctggggctcctgctgctctggctccaggtatcaaatgtgacatccagatgacccagtctaccttccacctgtctgacntcgtgtcggacgacagagtcacattctacttcggccggactagtacaggtgttcggttacggtaccgttgggttggtccttggttacgtccgtaagtccgaaaacggtaaaccggaacggggaaacctcccccggttaaagcccttccggtacgtaccgttacgttaacgtacgtcggttacctacccttaacctaaacgtttacgggtaaacgggtaaaacggggttccgggttaaaccctaaccggttaacggtaacggttttacggaccggggtaaccggtattaagggggtacggtacgtttaccgggttaacggggaaacctaaggttaaccgtttaacccttaccggttaaccctacgtaacccgttgtaaccctaagtacccgtacgttaaacccgttacccgacgggtaacccgttgaacggtttagttaccggtttaacttaacggttaacttttaacgtttacgttaaccgaaacgttaacttaacgtttaagtaaacgttaccgttttaaaccgtttccgggtttaacccgtttacccgggtacccgggtttaacggtaaacccgttaaacgggttacgtttaaccggttacgtttaaccgtaaaccgggttaaaaacgtttaacccggtgggtttaaccccgaaccggttcggtaaccccgttaacgttaccccgtttcgggtttaaccctttaccgttaacccttttccccgg

SEQ ID NO: 167855 - DNA, 648 bp, Homo sapiens
  misc_feature: GYAE6OF02JWLMK.16.81.H04.1.454.CMB.1.raw
  modified_base (183)..(183): a, c, t, g, unknown or other
  misc_feature (183)..(183): n is a, c, g, or t
  modified_base (366)..(366): a, c, t, g, unknown or other
  misc_feature (366)..(366): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagtgtactactccacgaccggtgctcgatttagtagtgtagattcgcgggggtcagactcagtcaggacacagcatggacatgacggggtccccgctcagctccgtgggggctcctgcctgctctggctcccaggtatcaaatgtagacactccagatgacccagtctcctcccacccgtntctagctatcgtgtacggagacagtagtacccacactcctacttcgggaccccgggtacaacgtcgaaggttagttcggtttacgggtaccgttgggtcggtacccgttgtagtccacgacgaaacgaaacccgagggtaaacctccccgtaagccgtctagactcgatcgatcgtacctaanacgtaaggtaggtaaacgtcgggttacacgtgtacggtcagcggnaacggttgatttcggacgganaacgttntactcgtacctactacagtaacagcaacttaccgacgtacgtcgtacgtagtaccgtagttcgtagtacttgtactacacaaacgtagttataagttactttaactacgttaccggttccgtaacctacggaacctaagttcggtactacgtagaaccgttaacgtacggtcggtactcaacggtacctataccgtgttactcgttacc

SEQ ID NO: 167856 - DNA, 795 bp, Homo sapiens
  misc_feature: GYAE6OF02FJCK9.16.81.H04.1.454.CMB.1.raw
  modified_base (199)..(199): a, c, t, g, unknown or other
  misc_feature (199)..(199): n is a, c, g, or t
tcagtgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtcctccttccaccctgtctgcatcgtgtcggagacgagngtacacatctacgttcggcccggtccagtcagtagttggttcggtaccgtggtcggtccgtggtatcagcgaacgaaaccgtaacgggaaaccgtacccccgtaaaggtcctacccgtagtaccttacgttatagtaacgttcgttacctaccgtaaagttaggtacgggtaaaacggttccgggtaccctagttaccgtaacgggttaccgaacggtccggtacgtaacgggtacggtacgtacggttacgggaaccgtaaggtaaacctttacctaccgttacccgtaccaacccgtaccgacgaacgtaaccgtaaccgtcccgtaaaccgtacgtaccgtacgggttaattaccggttaacgttttcggtaacctttacgtttaactttaacgtacccgtaacaacgtaacgttaaagtaaagttaccgttttaacgtttaacgttacccggttttcccgaacccggtttaccgggaaccctagtttacggttacgtaagttaaccgtaaaccgaaaccggttaaaccgtcggtacggtaaccgtaccgtaaccctaaccgttagtacccgtttacgtttaacccgttaccc

SEQ ID NO: 167857 - DNA, 152 bp, Homo sapiens
  misc_feature: GYAE6OF01BDXUI.25.30.C08.1.454.CMB.1.raw
  modified_base (150)..(152): a, c, t, g, unknown or other
  misc_feature (150)..(152): n is a, c, g, or t
tcagactgtacagtcacgaccggtgctcgatttagtctgacgtcaagggaagggaccaaggtggaatcaacgaactgtggctgcaccatctgtcttcatcttcccgccatctgaactgtacagtctgagcgggctggcaaggcgcatagnnn

SEQ ID NO: 167858 - DNA, 154 bp, Homo sapiens
  misc_feature: GYAE6OF01EQA21.25.30.C08.1.454.CMB.1.raw
  modified_base (154)..(154): a, c, t, g, unknown or other
  misc_feature (154)..(154): n is a, c, g, or t
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatagn

SEQ ID NO: 167859 - DNA, 155 bp, Homo sapiens
  misc_feature: GYAE6OF01BOQOP.25.30.C08.1.454.CMB.1.raw
  modified_base (154)..(155): a, c, t, g, unknown or other
  misc_feature (154)..(155): n is a, c, g, or t
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatagnn

SEQ ID NO: 167860 - DNA, 164 bp, Homo sapiens
  misc_feature: GYAE6OF01C8SPX.25.30.C08.1.454.CMB.1.raw
  modified_base (154)..(164): a, c, t, g, unknown or other
  misc_feature (154)..(164): n is a, c, g, or t
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatagnnnnnnnnnnn

SEQ ID NO: 167861 - DNA, 161 bp, Homo sapiens
  misc_feature: GYAE6OF01CDV57.25.30.C08.1.454.CMB.1.raw
  modified_base (154)..(161): a, c, t, g, unknown or other
  misc_feature (154)..(161): n is a, c, g, or t
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatagnnnnnnnn

SEQ ID NO: 167862 - DNA, 156 bp, Homo sapiens
  misc_feature: GYAE6OF01DZZUH.25.30.C08.1.454.CMB.1.raw
  modified_base (154)..(156): a, c, t, g, unknown or other
  misc_feature (154)..(156): n is a, c, g, or t
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatagnnn

SEQ ID NO: 167863 - DNA, 154 bp, Homo sapiens; identical to SEQ ID NO: 167858
  misc_feature: GYAE6OF01C6EEP.25.30.C08.1.454.CMB.1.raw
  modified_base (154)..(154): a, c, t, g, unknown or other
  misc_feature (154)..(154): n is a, c, g, or t

SEQ ID NO: 167864 - DNA, 161 bp, Homo sapiens; identical to SEQ ID NO: 167861
  misc_feature: GYAE6OF01CY8T9.25.30.C08.1.454.CMB.1.raw
  modified_base (154)..(161): a, c, t, g, unknown or other
  misc_feature (154)..(161): n is a, c, g, or t

SEQ ID NO: 167865 - DNA, 158 bp, Homo sapiens
  misc_feature: GYAE6OF01B6FFH.25.30.C08.1.454.CMB.1.raw
  modified_base (154)..(158): a, c, t, g, unknown or other
  misc_feature (154)..(158): n is a, c, g, or t
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatagnnnnn

SEQ ID NO: 167866 - DNA, 183 bp, Homo sapiens
  misc_feature: GYAE6OF01BSB8D.25.30.C08.1.454.CMB.1.raw
  modified_base (157)..(183): a, c, t, g, unknown or other
  misc_feature (157)..(183): n is a, c, g, or t
tcagactgtacagtcacgaccggtgctcgatttagtctgacgtcaaagggaaagggaccaaggtagggaaatcaaacgaactgtggctgcaccatctgtcttcatcttcccgccatctgaactgtacaggtctgagcgggctggcaaggcgcatagnnnnnnnnnnnnnnnnnnnnnnnnnnn

SEQ ID NO: 167867 - DNA, 153 bp, Homo sapiens
  misc_feature: GYAE6OF01CXRF2.25.30.C08.1.454.CMB.1.raw
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatag

SEQ ID NO: 167868 - DNA, 156 bp, Homo sapiens; identical to SEQ ID NO: 167862
  misc_feature: GYAE6OF01EP6G7.25.30.C08.1.454.CMB.1.raw
  modified_base (154)..(156): a, c, t, g, unknown or other
  misc_feature (154)..(156): n is a, c, g, or t

SEQ ID NO: 167869 - DNA, 153 bp, Homo sapiens
  misc_feature: GYAE6OF01B938R.25.30.C08.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
tcagactgtacagtcacgaccggtgctcgatttagtctgacgtcaaagggaaagggaccaaggtggaaatcaaacgaactgtggctgcaccatctgtcttcatcttcccgcatctgaactgtacagtctgagcgggctggcaaggcncatagn

SEQ ID NO: 167870 - DNA, 222 bp, Homo sapiens
  misc_feature: GYAE6OF01DEW17.25.30.C08.1.454.CMB.1.raw
  modified_base (213)..(222): a, c, t, g, unknown or other
  misc_feature (213)..(222): n is a, c, g, or t
tcagactgtacagtcacgaccggtgctcgatttagtctgacgtcaaagggaaagggaccacggtcaccgtctcctcagcctccaccaagggcccatcggtcttcccctggcgccctgctccaggagccacctccgagagcacagcggccctgggctgcctggtcaaggactacttccactgtacagtctgagcgggctggcaaggcgcatagnnnnnnnnnn

SEQ ID NO: 167871 - DNA, 154 bp, Homo sapiens
  misc_feature: GYAE6OF01C4SVT.25.30.C08.1.454.CMB.1.raw
  modified_base (144)..(144): a, c, t, g, unknown or other
  misc_feature (144)..(144): n is a, c, g, or t
  modified_base (149)..(154): a, c, t, g, unknown or other
  misc_feature (149)..(154): n is a, c, g, or t
tcagactgtacagtcacgaccggtgctcgatttagtctgacgtcaaagggaaagggaccaaggtggaaatcaaacgactgtggctgcaccatctgtcttcatctcccgcatctgaactgtacagtctgagcggctggcaaggcnattgnnnnnn

SEQ ID NO: 167872 - DNA, 161 bp, Homo sapiens
  misc_feature: GYAE6OF01D7CYK.25.30.C08.1.454.CMB.1.raw
  modified_base (156)..(161): a, c, t, g, unknown or other
  misc_feature (156)..(161): n is a, c, g, or t
tcagactgtacagtcacgaccggtgctcgatttagtctgacgtcaaagggaaagggaccaaggtggaaatcaaacgaactgtggctgcaccatctgtcttcatccttcccgcatctgaactgtacagtctgagcgggctgggacaaggcgcatagnnnnnn

SEQ ID NO: 167873 - DNA, 154 bp, Homo sapiens; identical to SEQ ID NO: 167858
  misc_feature: GYAE6OF01D2CCU.25.30.C08.1.454.CMB.1.raw
  modified_base (154)..(154): a, c, t, g, unknown or other
  misc_feature (154)..(154): n is a, c, g, or t

SEQ ID NO: 167874 - DNA, 156 bp, Homo sapiens; identical to SEQ ID NO: 167862
  misc_feature: GYAE6OF01D6ZVK.25.30.C08.1.454.CMB.1.raw
  modified_base (154)..(156): a, c, t, g, unknown or other
  misc_feature (154)..(156): n is a, c, g, or t

SEQ ID NO: 167875 - DNA, 151 bp, Homo sapiens
  misc_feature: GYAE6OF02IF5LV.25.30.C08.1.454.CMB.1.raw
  modified_base (151)..(151): a, c, t, g, unknown or other
  misc_feature (151)..(151): n is a, c, g, or t
tcagactgtacagtcacgaccggtgctcgatttagtctgacgtcaaaggaagggaccaaggtggaatcaaacgaactgtggctgcaccatctgtcttcatcttcccgccatctgaactgtacagtctgagcgggctggcaaggcgcatagn

SEQ ID NO: 167876 - DNA, 167 bp, Homo sapiens
  misc_feature: GYAE6OF02HN5ZC.25.30.C08.1.454.CMB.1.raw
  modified_base (153)..(167): a, c, t, g, unknown or other
  misc_feature (153)..(167): n is a, c, g, or t
tcagactgtacagtcacgaccggtgctcgatttagtctgacgtcaaagggaaggaccgaaggtggaaatcaaacgaactgtggctgcaccatctgtcttcatcttcccgccatctgaactgtacagtctgagcgggctggcaaggcgcatagnnnnnnnnnnnnnnn

SEQ ID NO: 167877 - DNA, 154 bp, Homo sapiens; identical to SEQ ID NO: 167858
  misc_feature: GYAE6OF02GN003.25.30.C08.1.454.CMB.1.raw
  modified_base (154)..(154): a, c, t, g, unknown or other
  misc_feature (154)..(154): n is a, c, g, or t

SEQ ID NO: 167878 - DNA, 162 bp, Homo sapiens
  misc_feature: GYAE6OF02HC8TW.25.30.C08.1.454.CMB.1.raw
  modified_base (154)..(162): a, c, t, g, unknown or other
  misc_feature (154)..(162): n is a, c, g, or t
tcagactgtacagtcacgaccggtgctcgatttagtctgacgtcaaagggaaagggaccaaggtggaaatcaaacgaactgtggctgcaccatctgtcttcatcttcccgccatctgaactgtacagtctgagcgggctggcaaggcgcatagnnnnnnnnn

SEQ ID NO: 167879 - DNA, 213 bp, Homo sapiens
  misc_feature: GYAE6OF02HV17V.25.30.C08.1.454.CMB.1.raw
  modified_base (212)..(213): a, c, t, g, unknown or other
  misc_feature (212)..(213): n is a, c, g, or t
tcagactgtacagtcacgaccggtgctcgatttagtctgacgtcaaagggaaagggaccacggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnn

SEQ ID NO: 167880 - DNA, 154 bp, Homo sapiens; identical to SEQ ID NO: 167858
  misc_feature: GYAE6OF02F0A77.25.30.C08.1.454.CMB.1.raw
  modified_base (154)..(154): a, c, t, g, unknown or other
  misc_feature (154)..(154): n is a, c, g, or t

SEQ ID NO: 167881 - DNA, 151 bp, Homo sapiens
  misc_feature: GYAE6OF02GNYIY.25.30.C08.1.454.CMB.1.raw
  modified_base (151)..(151): a, c, t, g, unknown or other
  misc_feature (151)..(151): n is a, c, g, or t
tcagactgtacagtcacgaccggtgctcgatttagtctgacgtcaagggaagggaccaaggtggaaatcaaacgaactgtggctgcaccatctgtcttcatcttcccgccatctgaactgtacagtctgagcggctggcaaggcgcatagn

SEQ ID NO: 167882 - DNA, 165 bp, Homo sapiens
  misc_feature: GYAE6OF02FU0H0.25.30.C08.1.454.CMB.1.raw
  modified_base (149)..(165): a, c, t, g, unknown or other
  misc_feature (149)..(165): n is a, c, g, or t
tcagactgtacagtcacgaccggtgctcgatttagtctgacgtcaaagggaaggaccaaggtggaatcaaacgaactgtggctgcaccatctgtcttcatcttcccgcatctgaactgtacagtctgagcggctggcaaggcgcatagnnnnnnnnnnnnnnnnn

SEQ ID NO: 167883 - DNA, 154 bp, Homo sapiens; identical to SEQ ID NO: 167858
  misc_feature: GYAE6OF02G76GG.25.30.C08.1.454.CMB.1.raw
  modified_base (154)..(154): a, c, t, g, unknown or other
  misc_feature (154)..(154): n is a, c, g, or t

SEQ ID NO: 167884 - DNA, 158 bp, Homo sapiens; identical to SEQ ID NO: 167865
  misc_feature: GYAE6OF02HOQ1A.25.30.C08.1.454.CMB.1.raw
  modified_base (154)..(158): a, c, t, g, unknown or other
  misc_feature (154)..(158): n is a, c, g, or t

SEQ ID NO: 167885 - DNA, 154 bp, Homo sapiens; identical to SEQ ID NO: 167858
  misc_feature: GYAE6OF02GTYBW.25.30.C08.1.454.CMB.1.raw
  modified_base (154)..(154): a, c, t, g, unknown or other
  misc_feature (154)..(154): n is a, c, g, or t

SEQ ID NO: 167886 - DNA, 154 bp, Homo sapiens; identical to SEQ ID NO: 167858
  misc_feature: GYAE6OF02FY29S.25.30.C08.1.454.CMB.1.raw
  modified_base (154)..(154): a, c, t, g, unknown or other
  misc_feature (154)..(154): n is a, c, g, or t

SEQ ID NO: 167887 - DNA, 156 bp, Homo sapiens; identical to SEQ ID NO: 167862
  misc_feature: GYAE6OF02FYBGF.25.30.C08.1.454.CMB.1.raw
  modified_base (154)..(156): a, c, t, g, unknown or other
  misc_feature (154)..(156): n is a, c, g, or t

SEQ ID NO: 167888 - DNA, 224 bp, Homo sapiens
  misc_feature: GYAE6OF02I1LQE.25.30.C08.1.454.CMB.1.raw
  modified_base (211)..(224): a, c, t, g, unknown or other
  misc_feature (211)..(224): n is a, c, g, or t
tcagactgtacagtcacgaccggtgctcgatttagtctgacgtcaaagggaaagggaccacggtcaccgtctcctcagcctccaccaagggccatcggtcttcccctggcgccctgctccaggagcacctccgagagcacagcggccctgggctgcctggtcaaggactacttccactgtacagtctgagcgggctggcaaggcgcatagnnnnnnnnnnnnnn

SEQ ID NO: 167889 - DNA, 154 bp, Homo sapiens; identical to SEQ ID NO: 167858
  misc_feature: GYAE6OF02GQQV6.25.30.C08.1.454.CMB.1.raw
  modified_base (154)..(154): a, c, t, g, unknown or other
  misc_feature (154)..(154): n is a, c, g, or t

SEQ ID NO: 167890 - DNA, 223 bp, Homo sapiens
  misc_feature: GYAE6OF01EKIGP.40.12.B01.1.454.CMB.1.raw
  modified_base (221)..(223): a, c, t, g, unknown or other
  misc_feature (221)..(223): n is a, c, g, or t
tcagtctagcgactcacgaccggtgctcgatttagtagtgtagatttgacttctggggccagggaaccccggtcaccgtctccgcagcctccaccaagggcccatcggtcttcccctggcgccctgctccaggagcacctccgagagcacagcggccctgggctgcctggtcaaggactacttccagtcgctagactgagcgggctggcaaggcgcatagnnn

SEQ ID NO: 167891 - DNA, 228 bp, Homo sapiens
  misc_feature: GYAE6OF01E0CKD.40.12.B01.1.454.CMB.1.raw
  modified_base (221)..(228): a, c, t, g, unknown or other
  misc_feature (221)..(228): n is a, c, g, or t
tcagtctagcgactcacgaccggtgctcgatttagtagtgtagatttgacttctggggccagggaaccccggtcaccgtctccgcagcctccaccaagggcccatcggtcttcccctggcgccctgctccaggagcacctccgagagcacagcggccctgggctgcctggtcaaggactacttccagtcgctagactgagcgggctggcaaggcgcatagnnnnnnnn

SEQ ID NO: 167892 - DNA, 236 bp, Homo sapiens
  misc_feature: GYAE6OF01B0W6C.40.12.B01.1.454.CMB.1.raw
  modified_base (222)..(236): a, c, t, g, unknown or other
  misc_feature (222)..(236): n is a, c, g, or t
tcagtctagcgactcacgaccggtgctcgatttagtagtgtagatttgacgttctggggccagggaaccccggtcaccgtctccgcagcctccaccaagggcccatcggtcttcccctggcgccctgctccaggagcacctccgagagcacagcggccctgggctgcctggtcaaggactacttccagtcgctagactgagcgggctggcaaggcgcatagnnnnnnnnnnnnnnn

SEQ ID NO: 167893 - DNA, 568 bp, Homo sapiens
  misc_feature: GYAE6OF01CQ1N7.40.12.B01.1.454.CMB.1.raw
tcagtctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttaataactatgtctcctggtaccaactacaccaggcaaagccccaaaactcatgactttctgacgtcaagtaagcggccctcgacggggtccctgatcgcttctctggctccaagtctggcaaacacggcctccctgaccgttctcgtcgggctccgaggctagaacgatgaggctagtatttatactgctactcgtatggcagggcgacaaacgtaagtttcgggtcttacggggcggaaggaccgaagcgtcgaacccgttcctaagggtccaaggtcccaaggcctccgcccccgtcggtccacttccgtcgttccccgtcccc

SEQ ID NO: 167894 - DNA, 584 bp, Homo sapiens
  misc_feature: GYAE6OF01DK1NP.40.12.B01.1.454.CMB.1.raw
  modified_base (255)..(255): a, c, t, g, unknown or other
  misc_feature (255)..(255): n is a, c, g, or t
  modified_base (305)..(305): a, c, t, g, unknown or other
  misc_feature (305)..(305): n is a, c, g, or t
tcagtctagcgactcacgaccggtgctcgatttagtagtgtagattccgcgggggggtctcgacggaggcagcgctctcaggacgtcaccaccatggcctgggcctctgctcctcctcaccctcctcactcagggcacaggtcctggcccagtctgccctgactcagcctccctccgcgtcccgggtctcctggaccagtccagtcaccatctcctgcactggaacccagcgacgtgacgttggtgttataactntcgtctcctggtaccaactacaccagcaaagccccaaatcatgatttcgngacgtcagtaagcgcctcagggttccctgatcgcttctcgtggctaccgaagttcgtaggcaaacacggccttcccgtggacccgttcgtcgtcggggccttccgacggtcctaggaacgtacgtaggacggctagtaatttacttactcgtcctactcgtactcgcacggtcgacaacaagttcgggtcttcgggcggacgggaccaagccgtagaccgtcgtaggtcagcccgaaggcctacgcccccgtcggtacacctcctcgttcccctacccg

SEQ ID NO: 167895 - DNA, 230 bp, Homo sapiens
  misc_feature: GYAE6OF01BEVHR.40.12.B01.1.454.CMB.1.raw
  modified_base (219)..(230): a, c, t, g, unknown or other
  misc_feature (219)..(230): n is a, c, g, or t
tcagtctagcgactcacgaccggtgctcgatttagtagtgtagatttgacttctggggccagggaaccccggtcaccgtctccgcagcctccaccaagggcccatcggtcttcccctggcgccctgctccaggagcacctccgagagcacagcggcctgggctgcctggtcaaggactacttccagtcgctagactgagcggctggcaaggcgcatagnnnnnnnnnnnn

SEQ ID NO: 167896 - DNA, 539 bp, Homo sapiens
  misc_feature: GYAE6OF01CHRVB.40.12.B01.1.454.CMB.1.raw
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
tcagtctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttanaactatgtctcctggtaccaactacacccaggcaaacgccccaaactcatgatttcngacgtcagtaagcgccctgagggtccctgatcgcttctctggctccaagtctggcaacacggcctcctgaccgtctcgtggctcgaggctgaagatggagctgattattactgtctactcgtatgcaggcggacaacgtagttgggtcttcgggcggagggaccaagcgtcgaccgtcgtaggtccagcccgaaggcctacgcccccgtcggtaccacttcctcgttccccgtccccg

SEQ ID NO: 167897 - DNA, 596 bp, Homo sapiens
  misc_feature: GYAE6OF01CT47K.40.12.B01.1.454.CMB.1.raw
  modified_base (249)..(249): a, c, t, g, unknown or other
  misc_feature (249)..(249): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactntgtctcctggtaccactacacccaggcaaacgccccaaatcatgatttctgacgtcagtaacgccggccctgacgggtccctgatcgcttctctgctcaagtctggcaaacgccggcctcccgtcgacctctcgtcgggctccgaggtctagaagagtggaggtctagtaatttattactgtcttactcgttatcgcgagggcgaacaacgtagtttcgggtcgttacgggacgggaacgggaccaaggtccgtacggtacccgtcgtacggtccaacggtaccccgaaggtccctacccggcccccgttcgggtacctacccgttcctccgttcccccctaccccg

SEQ ID NO: 167898 - DNA, 609 bp, Homo sapiens
  misc_feature: GYAE6OF01AIB3L.40.12.B01.1.454.CMB.1.raw
tcagtctagcgactcacgaccggtgctcgatttagtagtgtagattcggcggggaacgtcgaagtcgaaggactcctacaagttcaccgttctcacaactgaggctccctgctctacgcctcctgggctagctaatgctctggggtcgtctgggatccgaggtggggatattgtgatgactcagtctccactctccctgcccgtcactcctggagagccggcctcatctcctgcaggtctagtcagagcctacctaaacactaatggactactactcttgaattggtacctgcagaagccagggcagtctcacagctctgatatagttggggttcttagtccggggcctccggggtcccttgacagggtttcaggtggcagtgggattcaggtcacagtacttttaacacttacgaaattcgaaggtcgtggggtaggaggtcgaagtagattggttgggtatttagttactgactagtcgtacaaccttacttaacaacgttggtacggtcgggaccgggttacgggaacccgtaaggggacccgaaagggttacgggaaagttacgaaacggtaccggtaaacgtgggtacggtacgcggtaacccg

SEQ ID NO: 167899 - DNA, 541 bp, Homo sapiens
  misc_feature: GYAE6OF01BH5LM.40.12.B01.1.454.CMB.1.raw
  modified_base (299)..(299): a, c, t, g, unknown or other
  misc_feature (299)..(299): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaactacaccaggcaaacgccccaaactcatgatttcngacgtcagtaacgcggccctcgacggggtccctgatcgcttctctggctccagtctggcaacacggcctccctgacctctcgtcgggcctccgaggctcgaagatggaggctgtattattactgtctactcgtatgacgaggcgacaacgtagttcgggtcgttcgggacggtaggaccgaagcgtcgaccgtccgtaggtcacgccaggcctcgccccgtgcctactcctcgtcccctccc

SEQ ID NO: 167900 - DNA, 720 bp, Homo sapiens
  misc_feature: GYAE6OF01BDW2E.40.12.B01.1.454.CMB.1.raw
tcagtctagcgactcacgaccggtgctcgatttagtagtgtagatttcggtcggggggtgcccgtgacgagcatcgacccagcaacctacatctgtcctctagagaatcccctgagagctccgttcctcaccatggtactggacctggaggattccttcttcttggtggtacagcagccgcaggagcccactcccgaggtgcagcgtggtgcagtcgtggggctggacggtgaagaacgccgtggggcctcggtgaaggtcctccgtgcaagtatttcgtacggaaaccacctagagacaactacgtacatacactggagtggcggcgacggtccccgtggtaccgttaggggttttacgaggttgggtaaggttgggggtaggaacgttaccgtaaaccccgttaccgaaggagggtacggacgaacggaaacggtacgtacgtaacgaacgtaactttcgacgggacgtaacgggtaccaaccgagtacggaaccgtcggggaccgtccggttacctaacgtacgtaacggacaaccgtacggttacctaacgtacgtacgggtacttccggtacggacggtccgggtaacgttacggtaacccgttacggtacggaaccgaacgaccgggtaccgtacggtacgttaacgttacgtacggtacggaacgtaggtaacggttgggtacggaccggtaccgggcgggtccgtaaccggg

SEQ ID NO: 167901 - DNA, 702 bp, Homo sapiens
  misc_feature: GYAE6OF01C7KK2.40.12.B01.1.454.CMB.1.raw
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
tcagtctagcgactcacgaccggtgctcgatttagtagtgtagattccgcgggggggtctcaggaggcagcgctctcaggacgtcaccaccatggcctggctctgctcctcctcaccctcctcactcagggcacagggtcctgggcccagtctgccctgactcagcctcctcgcgtccggtctcctggacagtcagtcaccatcctcctgcactggaaccagcagtgacgttggtgttataactntgtctctgtaccactacaccagcaaacgcccaaatcatgattctgacgtcagtaacgccggcctcgacgggtcctgatcgcttcnctgctcaagtctggcaacgacgcctacctgacccgtctcgtcggtctccgagcctaggtaacgagttacggaggtccttagtaaacgtttacttaacgtcggttacttaaccgttcgttaagttcggtaccgaaggggacccggtaacgtaaaaccgttacggttttaccggggttaccgttaccggggtaccggggtaacgggtaaacccgtaagggttcccggtaacggtaaccccggttaaccggttaaccgggtttacccgaaacccgggtaccccgtaaaacggggtcccccgttccgggtaccccccccttacggggttaaaccctcccgttttacccgaccccggttttccccccgtacccccgg

SEQ ID NO: 167902 - DNA, 663 bp, Homo sapiens
  misc_feature: GYAE6OF01CUK17.40.12.B01.1.454.CMB.1.raw
  modified_base (261)..(261): a, c, t, g, unknown or other
  misc_feature (261)..(261): n is a, c, g, or t
tcagtctagcgactcacgaccggtgctcgatttagtagtgtagattccggcggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatcctcctgcacgtggaaccagcaggtgacggtttggtaggttaataaactntcgtctccgtcggtaaccaactaccacccgaggaccaaaaccgacccccaaaactcattgtactttcacgacgtcaagtaacgccggtcctcgacgggtccctagactcgtcttctgtcggcctaccgaagttcgacggaccaaaccgtccggccctcccgtcgtacccgtcgtgcgggcctcggagctaggactagtggactcgtagttactttagtacgagtccttaacgtcgtatcgcgaagggccgaactaaacggttcgtttcgggtccggttcgggacgggaacggaccaaggtctaaccgggacccttacgtacgggtcccaacgggcccgtaaccggcccgtacccgtcccccggttcggaccctaccgttccgttcccgttcccccctacccg

SEQ ID NO: 167903 - DNA, 723 bp, Homo sapiens
  misc_feature: GYAE6OF01BRVB8.40.12.B01.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacngtcagtcaccatcctcctgcactcggaaccngcagtgacgttggtgttataactntgtctctgtaaccaactacaccagacaaacgaccccaaactcatgtactttcngtacgtcagtacgccgtccctcggacgggtccctagactcgtcttctcgtcggcctacgaacgttcncggtacaaccgaccggtccctccctcggtacccgttcgtccggtcgggtccctaccgtacggtcgtacggaaacgtacgtacgggacggtacgttacggttaatttaacgtttacgttcgtaccgtttacgttaccggttatcggacggtacgggaccgtaacgtaaacgttacggtttccggggttaccgttaccggggacgggtaaccgggtaacgtaacggtccgtaccggttacccggttaccgtaccggtccgaaccggtccccgggtaaacgtccccgttaccccgggtcccccgttacggttacccgtacccgtttccgttccccgttcccccgtaacccccg

SEQ ID NO: 167904 - DNA, 680 bp, Homo sapiens
  misc_feature: GYAE6OF01ESD1D.40.12.B01.1.454.CMB.1.raw
tcagtctagcgactcacgaccggtgctcgattttagtagtgtagattacggacggggactgatcaggactcctcgagttcaaccttctcacaatgaggctccctgctcagctcctggggctgctaatgctctgggtctctggatcaggtgggattattgtgatgactcattcctccactctccctgcccgtcactcctggacgcgccggcctcacttcctcgtgcaggtcctagtcagactccctacctaaacactaagtcggacttacctacttctttagaactttcggtacctgacaggaacgccgagggcacgtcctccacgcgtccttcgttagactttagttacggtttcgggttacttacggccggggtccccgttccggggtccctagggtaccttagggttccgacgggttcggacgtaacgggtggtaactcgtacgtaccgtattaacggttactttaccgactaagtaactcgaggacgtagggtcgagtacgagtaaagtcgttaggttaggttaactttacgtacgtgacgtagtacgacccttaacctacgtaacgtaacgttgggtacggtacgggtaccggtaccgggaacgtaacgggtaacgtaacggggtaactaaaccgacgtaaacggtacgtacgttaggtcggaccgtcgtaacccg

SEQ ID NO: 167905 - DNA, 631 bp, Homo sapiens
  misc_feature: GYAE6OF01BOZ1E.40.12.B01.1.454.CMB.1.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttggtgttataactatgtctcctggtaccaactacaccaggcaaacgccccaaatcatgtatttcngacgtcgacgtaagccggccctcgacggggtccctgactcgcttctcngctcaagtctcggacaacgacggcctccctcgaccgtctcgtgggcctccgacggctagaacgagtggacgtcgtagtaatttacttactacgtcttaacgttcgtaagtcgacgagggtaccggaactaacgtaggtttcggggttcgttacgggcggaacgggacctaaaggccgtacggaccgttccgttaagggtccaaccggtacccggaaggcccgttacccgccccccggttacggtcccaaccgtttcccgttcccgtttcccccctaaccccg

SEQ ID NO: 167906 - DNA, 717 bp, Homo sapiens
  misc_feature: GYAE6OF01E12VX.40.12.B01.1.454.CMB.1.raw
  modified_base (268)..(268): a, c, t, g, unknown or other
  misc_feature (268)..(268): n is a, c, g, or t
tcagtctagcgactcacgaccggtgctcgatttagtagtgtagattcgcaggggagcatcacccagcaaccacatctgtcctctagagaatcccctgagagctccgttcctcaccatggactggacctggaggatcctcttcttggtggcagcagccgcaggacgcccactcccaggtgcagctggtgcaggtcgtggggctggaggtgaagagcctggggcctcggtgaacggtcctccgtagacaaggtatttacgacggaaaccnccgtgacgacctaactactacactacacgtggactcggcgacgaccggtcccgtaggtacggttagggttggaaggtggggtacgtggggtacgtactacccgtaaccgtacgtaggtacggtcgaacgaacgtaaagtacgacgtaacgtacgttaacgtacggacggtacggtacggtaccaactacgtacgggtaccgtaccgggaccgtcgttacaacgtccgacgtaaccgtacgtacgttacgacgtagggtccgtaacttcggacgtaacgggtcccggttaagtcccggtaaccgtaacggtaccgtaacccgggtaacgtacccggtattacgtacggttacgacggtttacggaaacggttaggtaccgggtacggtttaccggacccggttacgggaccggttcggacccggttaacgccgggttacccgggaccggg

SEQ ID NO: 167907 - DNA, 596 bp, Homo sapiens
  misc_feature: GYAE6OF01ERSAY.40.12.B01.1.454.CMB.1.raw
  modified_base (567)..(567): a, c, t, g, unknown or other
  misc_feature (567)..(567): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacggttggtggttaataacttatgtcctccgtaggtaccaactaccaaccaggaccaaacgacccccaaaactcatgtactttctacgaccgtcaagtaacggccggccctacggacggggtccctgacttccgtctttctcgtggacctaccgaagtctcggacaaccgtaccggccctccgtccgaccgttctcgtcgggcctccgagtcgtagaagtagtggagtctagtattacttactcgtaccttacgtcgtatcgacgagaccgactaacgtagttcgggtcgtcgggacggacggacagctcgaccgtcgtaggcacggccaggccnccgcccgtcgcactctcccgtcccgtccc

SEQ ID NO: 167908 - DNA, 689 bp, Homo sapiens
  misc_feature: GYAE6OF01D58QU.40.12.B01.1.454.CMB.1.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (515)..(515): a, c, t, g, unknown or other
  misc_feature (515)..(515): n is a, c, g, or t
tcagtctagcgactcacgaccggtgctcgatttagtagtgtagattcggcgggggagcatcacccagcaaccacatctgtcctctagagaatcccctgagagcctccgttcctcaccatggactggacctggaggatcctcttcttggtggcagcagccgcgaggacgcccactcccgaggtgcagtcgtggtgcagtcgtgggctggaggtagaagagccgtgggcctggtagacgtctcgtgactaagtnttcgacggaaaccnccgtagacgacaactactacatacagtaggatcggacggacgaccgggcccgttaggggacggttaggggtttagagggtacggtagggttgggggtacgtaccttaaccgaacccgtacgagggtaacggtacggaactaaacgtaaagtcgtacggaactagttaacgttacggacgggtacgacggtaacaccgtagtacgacggtcggaccgtctacagtcaacgtcaacgtacgttccctaagngtacggtactcgacgggtacggcgttacgtccgacgtcgaacggacgacgcgtacgactttagtagttaccggaggttacggaacgggttacgtacggggtcggcccggggtaacccacccgggggtggggtacccttaccggaacccggtagggtccggggggtaacccccgg

SEQ ID NO: 167909 - DNA, 638 bp, Homo sapiens
  misc_feature: GYAE6OF01CO5ZI.40.12.B01.1.454.CMB.1.raw
  modified_base (250)..(250): a, c, t, g, unknown or other
  misc_feature (250)..(250): n is a, c, g, or t
tcagtctagcgactcacgaccggtgctcgatttagtagtgtagattccgcggggggggtctcaggaggcagcgctctcaggacgtcaccaccatggcctgggctctgctcctcctcacccctcctcactcagggcacagggtcctgggcccagtctgccctgactcagcctccctccgcgtccggtctcctggacagtcagtcaccatctcctgcactggaaccagcagtgacgttggtgttaataactntgtctcctgtaccaactacacccaggaccaaacgccccaaactcatgtactttctgacgtcgagtaacgccggccctcgacggggtccctgactcgcttctctggcctaccgaagtcgtggcaacgacggccctcccgtcgacccgtctcgtcgggccttaccgaggcctagaagtagtcggagtctagtaatttattactcgtaccttacgtcgttaagtcgaccgaggcggactaaacgtagtttcggggttcgttacggggtcgaacggtacgaaccgtacggtcctacggtacccgtaccgttacgggtacgaacccggtacccgaaccgtcctccccggtcccccgttcggttacctacccgttcgttccccggttacccccc

SEQ ID NO: 167910 - DNA, 788 bp, Homo sapiens
  misc_feature: GYAE6OF01CC6MG.40.12.B01.1.454.CMB.1.raw
  modified_base (233)..(233): a, c, t, g, unknown or other
  misc_feature (233)..(233): n is a, c, g, or t
tcagtctagcgactcacgaccggtgctcgatttagtagtgtagattccggcgggggggggtctcaggaggcagcgctctcaggacgtcaccaccatggcctggctctgcctcctcctcaccctcctcactcgagggcacgacgggtccgtcgggcccaggtctcgccctgactcacgccctccctccggcggtccggtctccgtggacagtcacgtccacctactccttccgngccacgtacggaacacgtcgaggttcggtacgggtttagggtacggtttaactaacgttacgttcggttaccttaccgttacggttaaacccaaaccgtacccgaacccggaacggaacccaaaacccgtaacccccaaacgtcctaagtacgttactttcgtacgtacgtactaacgtaccggccgtacccgttacggtaccgggtccttacgtactcgtcgtttccgtcgttccggtacctcgttaaacgtcgtaaccggaccgtaaccgtccggtcccttaccgtaccggtcccgttcgtaccgggttacggtcccgtaccggtacggtaccgtaaggtaacggtcggtaacggccggtaacgttaggttaactttacttacgtcgttaccgtacgtcgtagacgtcggacgggtaccgaagtaacgtcgggttcgtccgggtacgggaccggttaggaccgtaacgtccgtaccggtacccgtacgtacggaccctcggacccgaccgtcgaccccgtcgtaccgtcctaccttccgtcccgtccctcccg

SEQ ID NO: 167911 - DNA, 669 bp, Homo sapiens
  misc_feature: GYAE6OF01DCGTM.40.12.B01.1.454.CMB.1.raw
  modified_base (49)..(49): a, c, t, g, unknown or other
  misc_feature (49)..(49): n is a, c, g, or t
  modified_base (168)..(168): a, c, t, g, unknown or other
  misc_feature (168)..(168): n is a, c, g, or t
  modified_base (180)..(180): a, c, t, g, unknown or other
  misc_feature (180)..(180): n is a, c, g, or t
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
tcagtctagcgactcacgaccggtgctcgatttagtagtgtagattcgngggcgtagactttgtgtttctcgtagtctccctgctcagctcctggggctgctaatgctctgggtctctggatccagtggggatatgtgatgactcagtctccactctccctgcccgtnactcctggaagngcccggactccatcctcctgcaggtctagtcagacgcctactaaanactaagtggatactacgtcttagaattgtactgcagagcagggcacgtcnccacagtctcttgatattagttgggtacttagtccggcgtacccgggtcctggaccgtaggttacgacggtggactacggtcggtatccgtaggtacaacccgtaggtaactttttaacacttaacggtaaaacttcgacggtaggacgggaggaacggaccgaagtaagtagtagttagggtatttagtaactcgctatcgaccacttactaccgaaagttcgttacgtacggacgggtccggtaaacccggaaacgggtaacccggaaaggtaaccggtaaaatacccggaaagtaaccggtaacggttacggtcgggtacgtaccgtacccgtaaccccgtaaagttcccgtttaccgggtatttacccaaccgttcccttacccccggg

SEQ ID NO: 167912 - DNA, 244 bp, Homo sapiens
  misc_feature: GYAE6OF01EN25I.40.12.B01.1.454.CMB.1.raw
  modified_base (225)..(244): a, c, t, g, unknown or other
  misc_feature (225)..(244): n is a, c, g, or t
tcagtctagcgactcacgaccggtgctcgatttagtagtgtagatttgacttctgggggccagggaaccccggtcaccgtctccgcagcctccaccaagggcccatcggtcttcccctggcgccctgctccaggagcacctccgagagcacagcggccctgggctgcctggtcaaggacttacttccagtcgctagactggagcgggctgggcaaggcgcatagnnnnnnnnnnnnnnnnnnnn

SEQ ID NO: 167913 - DNA, 697 bp, Homo sapiens
  misc_feature: GYAE6OF01BW5SZ.40.12.B01.1.454.CMB.1.raw
  modified_base (246)..(246): a, c, t, g, unknown or other
  misc_feature (246)..(246): n is a, c, g, or t
tcagtctagcgactcacgaccggtgctcgatttagtagtgtagattcggcgggggagcatcacccagcaaccacatctgtcctctagagaatcccctgagagctccgttcctcaccatggactggacctggaggatcctcttcttggtggctagcagccgcaggagcccactcccgaggtcgctagcctggtgcagtcgtggggctggaggtgaagagccgttggggcctcggtagacggtcctcngaccaagtcttacgtcggaacacccgtgacgctaactactacatacacgtggatcggcggccgacggtccccgtaggaccgggttagggggttttagacgggttagggtaggttgggggtacgggtaactttacccgaaaaccccgttaccgaaggggtacggtacggggacctaaacggtaaagtagttaaccggaacgtaacggttaaacgtttccgacggggtaccgtaggggtaccaccgtagttacggacccggtacggacgccgtacccagtcacggcaacggcttaacgttcgagtacggtctcgtgacggcccgaagtccgtacgtcgtaggaccgtacgaacgccgatttacggacttgacggtaggtaacggtgggtacgttcgggtaccggtcggaccgggtaccggtctacgggaaccgttcggggcgggtaaacccgg

SEQ ID NO: 167914 - DNA, 732 bp, Homo sapiens
  misc_feature: GYAE6OF01CDRJA.40.12.B01.1.454.CMB.1.raw
  modified_base (675)..(675): a, c, t, g, unknown or other
  misc_feature (675)..(675): n is a, c, g, or t
tcagtctagcgactcacgaccggtgctcgatttagtagtgtagattcggacggggggagacgcatcacccgagcaaccacatctgtcctctagagaatcccctgagagctccgttcctcaccatggactggacctggaggactcctcttcttggtggtcagcacgcccgacgacggacgcccactcccgaggtgcagtctggtgcagtcgtgggctgaggtagaacgagtccgtgggcctgggtgaaggtcctccgtgacgaagtactttcgaacggaacctccgtagacgtactaactacctacgtactacgacgtagagtcggaccggaccgtaccggccccgtagggtaccggtaggggttaggacggtagggtagggttacgggggtacgtaacgtacccgtaacccggtacggacggtagggtacgaaccgtaaacgtaaacgttacgtaccgtaactaacggttaacctttaccgggacgggtaccgtacgggtaccgtaaaccgttaggtaaccggtacccggttacggggaaccgtcccgggtacccgacgttaccggaccgtaccgaacgtacgtaccgtaagtacggtggtactacggtaggacggtccggtacgtcggacctacgggtacgaccgttacgacggtactcgttagtacgtacggngtaagggacgtaggtcggtcgcggtaccggtcggacggctacggcgcggtacccggg

SEQ ID NO: 167915 - DNA, 844 bp, Homo sapiens
  misc_feature: GYAE6OF01AZ7MB.40.12.B01.1.454.CMB.1.raw
  modified_base (233)..(233): a, c, t, g, unknown or other
  misc_feature (233)..(233): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacgagggtcctgggcccagtctgccctgactcacgcctccctccgcgtccgggtctccgtaggacagtcagtccaccatcctcctgcacgtcggaaccngctaggtgtacggttggtagttaataactgtgtctcgtaggtaccaacgtaccaccaggacaaaccgaccccaaatcatacgtactttcgtacggtacgtacgtaaggttaaccggtcccggtacccgttacgggtaccggggttaccctaggtaccgttcccgttcgttttccgtccgtccggtacccttaccgtaacgtcgtaacgggacctaacccggacccggtccctacccgtcgtacccgtacgtcgttcgggccctacgggtcgtacgtaacgaacggtacgtacggtacggtacgttaggttaactttaagtttaaccgtcgttaaccgttacgtttaccggtagtacggaaccggtacgggaccggtaaaccttaaacgggttcggtttaccggggtacggtttacccgggggaacggggtaaccgggtaaccctaacgggtaccccggttaaccgggtaaccccgttttacggggtaacccggtaacccggtaccgggtacccccggtaaacccggtcccgttaccccccgggttacccccggttccgggtacccctttacccggttccccggtttaccccgggttccccccttaccccgg

SEQ ID NO: 167916 - DNA, 730 bp, Homo sapiens
  misc_feature: GYAE6OF01CEMFD.40.12.B01.1.454.CMB.1.raw
  modified_base (719)..(719): a, c, t, g, unknown or other
  misc_feature (719)..(719): n is a, c, g, or t
tcagtctagcgactcacgaccggtgctcgatttagtagtgtagattcggcggggggagacgcatcacccgagcaaccacatctgtcctctagagaatcccctgagagctccgttcctcaccatggactcggacctggaggactcctcttcgtggtggcagcagccgcaggcgcccacgtcccagggtcgcgagtcgtgggtcgcgtaggtcggtggggctaggaggtaggaagtacgccggtcggggccctggtaggaacggtcctaccgtgacgtaacgtatttccggaaggtaaacctcccgtaggacgaccttaaacctacttaacgactaccgagtacggagtcggaccggcgtaccggtccccggtaggtaccggttaggggttcgaaggtggtacggtggggtacgacgtaccgaacccgtacgacggtaggtccggaagaacgtaaagtcgtacggactaacggtacttacggacgggactacgggtacccaacgtcgtacgggtccggtacgggaccgtacgtacgtacgtaccgacgtctaacgtaccgtccgacgtaacgtggtaacttcggcggtacggcgggtaaccttccggacgtttcgagttaacccgacgggtactccgtagtacgtaccgttaggacgggtggtaaacgtggacggttcggaaggggtcccgtaccggggtcggaccgttacggacccgggngggtacccggg

SEQ ID NO: 167917 - DNA, 604 bp, Homo sapiens
  misc_feature: GYAE6OF01CULGM.40.12.B01.1.454.CMB.1.raw
  modified_base (188)..(188): a, c, t, g, unknown or other
  misc_feature (188)..(188): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
tcagtctagcgactcacgaccggtgctcgatttagtagtgtagattcgctgggggagcatcacccagcaaccacatctgtcctctagagaatcccctgagagctccgttcctcaccatggactggacctggaggatcctcttcttggtggcagcagccgcaggcgcccactcccaggtgcagctggtncagtcgtgggctgaggtgaagagcgtgggcctggngagtctcngcagntttcngaacnccgtgacncaactactacattaacgctggatcggcgcacggcccttggacgtggggtttnacggtggtacggtggggtacggactaccgaacccgtacgaggtacggtagctaaacgtaagtactacgacgtacgtacttcggnggacgtaggtcacgagtacgccgtaggacgcgtccgatcgacgacgtacgactcgtaacgtagtaggacttgtacgtacggacgtacgtacggtacctgtaccggacgtaacccggacgtaccgttagtacgtagttacgtggtaacggtacggagttacgggttggtcggtaccgtaccgggtaccggtgtacggcccgtagggtacccgggg

SEQ ID NO: 167918 - DNA, 808 bp, Homo sapiens
  misc_feature: GYAE6OF01AZQ8S.40.12.B01.1.454.CMB.1.raw
  modified_base (121)..(121): a, c, t, g, unknown or other
  misc_feature (121)..(121): n is a, c, g, or t
  modified_base (136)..(136): a, c, t, g, unknown or other
  misc_feature (136)..(136): n is a, c, g, or t
  modified_base (222)..(222): a, c, t, g, unknown or other
  misc_feature (222)..(222): n is a, c, g, or t
tcagtctagcgactcacgaccggtgctcgatttagtagtgtagattccgcgggggggtctcaggaggcagcgctctcaggacgtcaccaccatggcctggctctgctcctcctcaccctcncactcagggccacgnggtcctagggcccagtcctgaccctgacctcagcccttccctccggcgtcccgggtctccgtaggacctaggtccacgtccaaccnttccgtccctgacctacgtacggaaccctgtccaaggtgtacggttgggtattaactaacgtgtcgtacctcgtcgtaccgaactacaccgagtacaaccaccccgaaactcgaactcgtaacttcgtacgtacgtacgtagtaacggccggtaccctcggacggtccgtacgtagtcccgtctttcgtcgttaccgggcttacccgtaaggtcgtacgggtacaacccgtaccggtcccttacccgtcgtaaccggttctccggttacggttaccgcccgacggttacgtacgtaaacggcgtcgtaacggtagttacgttaagtttaaccttacgtcgttacccttaacgttcgtaagttcccgtacggtaccgggtacggtaaaccgttaaaccgttcgggtttaccgggttaccgggttacgggttaacgggtaacccggaccgtaaaccggttccggaccggtttaaccggttacgtacccggttacgaccccgtaaaccggggttcgaaccccgttcccgtacccccgggtcgttacccgttaacccttcccgggttaacccggtccccgtttaccccgg

SEQ ID NO: 167919 - DNA, 715 bp, Homo sapiens
  misc_feature: GYAE6OF01BR97B.40.12.B01.1.454.CMB.1.raw
  modified_base (166)..(166): a, c, t, g, unknown or other
  misc_feature (166)..(166): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (595)..(595): a, c, t, g, unknown or other
  misc_feature (595)..(595): n is a, c, g, or t
  modified_base (608)..(608): a, c, t, g, unknown or other
  misc_feature (608)..(608): n is a, c, g, or t
  modified_base (617)..(617): a, c, t, g, unknown or other
  misc_feature (617)..(617): n is a, c, g, or t
  modified_base (677)..(677): a, c, t, g, unknown or other
  misc_feature (677)..(677): n is a, c, g, or t
tcagtctagcgactcacgaccggtgctcgatttagtagtgtagattcggcgggggagcatcacccagcaaccacatctgtcctctagagaatcccctgagacgcctccgttcctcacagtggactggacctgggagatcctctttcgtggtggcacgcacggccgngaggacgcccactcccgaggtgcgngcgtggncgacggttcggnggggactagggaggtagaacgtacggtccggtggggtcctgggtacggaacgtcctccgagaccgtaagttacgttacgacggaaaccnccgtagacgactaaactcgaacatacgngtagngtacggaccgcgaccgtcgtaggacggtagggttcaggtcggtagggttagggtaccgtaacgtaaccccgtaaccggtacggaaggttacgggaccggacaaaccggtaagtacgacggtaacacggtttaaccgtcgggaacgtggtaaccgactacgtacgggtcgtaccgggtaaggtacccgtcgtaaccgtacgtaaccgacacgttaacgacgttacgtaacctagggtacgtaactcgtaagggccgtacggtanacgtccggtaacncggaaccgngaaccggatacggtgtaaacgtggtaaacggcgggtaacgtcgggttaggcgtaaccggngggtaccgggcgtacgacgacggcggtcgggaacccgg

SEQ ID NO: 167920 - DNA, 698 bp, Homo sapiens
  misc_feature: GYAE6OF01CV4J3.40.12.B01.1.454.CMB.1.raw
  modified_base (115)..(115): a, c, t, g, unknown or other
  misc_feature (115)..(115): n is a, c, g, or t
  modified_base (443)..(443): a, c, t, g, unknown or other
  misc_feature (443)..(443): n is a, c, g, or t
  modified_base (540)..(540): a, c, t, g, unknown or other
  misc_feature (540)..(540): n is a, c, g, or t
  modified_base (557)..(557): a, c, t, g, unknown or other
  misc_feature (557)..(557): n is a, c, g, or t
  modified_base (668)..(668): a, c, t, g, unknown or other
  misc_feature (668)..(668): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (679)..(681): a, c, t, g, unknown or other
  misc_feature (679)..(681): n is a, c, g, or t
  modified_base (684)..(684): a, c, t, g, unknown or other
  misc_feature (684)..(684): n is a, c, g, or t
  modified_base (686)..(689): a, c, t, g, unknown or other
  misc_feature (686)..(689): n is a, c, g, or t
  modified_base (691)..(694): a, c, t, g, unknown or other
  misc_feature (691)..(694): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
tcagtctagcgactcacgaccggtgctcgatttagtagtgtagattcggcgggggagcatcacccagcaaccacatctgtcctctagagaactccctgagacgccttccgttccncaccgagtcggactcgggactggagtactcccttcttcgtttggcgacgagccgacggcccggagaacggaccgccccacccgtaccggaggtcgcgtaggtcgttggtacgcgtacgggtcgggtacggggcgttaggaacgggtaaggaaaccggtacgtccggggtacgggggtcccgtaggggttaccggtaacggttcctaccgtacggaacgttaacgtttactaccggtaaaccggtaacctaccggtagacgtaacctaaaccttacacgtaactacgtacggtaggctcgggaccgccgtacgggccgtagggtacggngggtgtacgggaggtggtagggactaccgtaaccgtacggagacggtacggcgaaacgtaaacgtaacgttcgaaccgaagtacgttaacgtacggnggtaagtacgtaccggnttacgcggtaaccgccggacgaccgtcgtacgacgtacaccgtactacgtccgtaacgtagtcgtacgtgtacggacgggtcgggcggtcggaacgacggtacgcgaacgnggacgtngngnnncgnannnntnnnngngn

SEQ ID NO: 167921 - DNA, 838 bp, Homo sapiens
  misc_feature: GYAE6OF01EXW4M.40.12.B01.1.454.CMB.1.raw
  modified_base (136)..(136): a, c, t, g, unknown or other
  misc_feature (136)..(136): n is a, c, g, or t
tcagtctagcgactcacgaccggtgctcgatttagtagtgtagattccgcggggggggtctcaggaggcagcgctctcaggacgtcaccaccaatggcctggctctgctcctcctcaccctcctcactcaggcacncgggttcctgggcccagtctcgcccgtgactcagtcctcccgtccgcggtccggtcctctggactagtcagtccaacctatccgttactgccaacgttaccggaaccagtcgtaagtcgtacgttggtagttataacgtgtcgttcctcgtacggtaaccaccgttaacgacccgtaaggaaccaaacccgacccctaaactacgtaactcgtttcgtttcgacggtaccgtcaaacgggttaccgacccgggtccggtaccggtacggggttacctcgggtacttccggttactctaccggtcgaccgttaccgtacgttccgcggtaacgaaccgtcccggtccctacgtaccggtcccgtaccttggggttccgggtacctaccggtacggtaccgttaaggtaacgggttaagtcggggtacgttaccgttaaacggttaacgttttactttaaccgggttacggttaacccttaaccgggtttacgaccggtacggttaaaccgggccgggttaaccgtaaacgtaaccggttacggttcggggttacccgggttacgaacggggtaaccgtaccgtaccggttcgtaacccgtcggtaaccgttacggacccgtaccgaccgggtactcccccgggttacccgtacccgtaacccggttccgttaccctcccgggttaccccgtccccttaccccg

SEQ ID NO: 167922 - DNA, 799 bp, Homo sapiens
  misc_feature: GYAE6OF01BMNT1.40.12.B01.1.454.CMB.1.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
  modified_base (467)..(467): a, c, t, g, unknown or other
  misc_feature (467)..(467): n is a, c, g, or t
tcagtctagcgactcacgaccggtgctcgatttagtagtgtagattcggcgggggagcatcgacccagcaaccacatctgtcctctagagaatccctgagagtctccgttacctcaccagtggactcggacctgggaggtacttcctcgttgttgggtcggcagcctaggcccgtacgaggaccgtccctacgtccgaggtcgcacgcgttggancctaggtcgtgggcgtgaggtcgaaggtaacgccgtggggacctggtagtacggtctcgngacgtaagttcgttacgacggaacctaccgtaggactacctaactatactacgttacgacgttcggagttcggacggaccaccgggtcccgtaaggtcggttacgggttacggttaaggtcggagggttacggggtacgtaaccttaccctaaaccggaccgaaggggttaccggtaagaacccggttaaanacggttaacgtaaccgaacggtaacgtaaccggttcggaccggtaggtaccggtaccacgtacgacggtaccggttaccggacgccggttacaacgtacgtacggaacctttaccgtacgacgtaccgtaagggtttcaacccttggaccgaccgggtaacggtcaaccggtttctaccggtacgaccaacgggtttaccaccgttaaagttcgtaaacgtccggtagtagggtaacgttagggtacccgggtttgggacccgttagggcccggtacccggggggtttacaacccgggacccgggttcggggttacccgtaaacccgggggg

SEQ ID NO: 167923 - DNA, 949 bp, Homo sapiens
  misc_feature: GYAE6OF01EXV9U.40.12.B01.1.454.CMB.1.raw
  modified_base (84)..(84): a, c, t, g, unknown or other
  misc_feature (84)..(84): n is a, c, g, or t
tcagtctagcgactcacgaccggtgctcgatttagtagtgtagattcggcgggggagcatcacccagcaaccacatctgtcctntagagaactcccctgagacgccttccggttccctcacctagtcggacgtcgggaccgtgggaggtacttcccttcttttcgttgggtcggccaagccgacgcccggacgacgggaccgcccctaaccgtccccgaagggttcgaccgaggtccgttgggtcgcgtcggtcggtcggggacgtagggtaagggtagaaacggaccgggtccgggtacggggtccgttcgggtacgggtaaccggttccctcggtagacgtaaacggttacgtttacgtaacggtaaacccgttacccggtaggaacctaacccgtaaaccgttaacctaacgtaacgtaaccggtaccggtaacgggtacgtaccgggccgggaccgaccccggggttacccgggttacgggggtaacgggggtttacggggttacggggacgggttaggggttacggggtacggggttacggttaacccgttaaccccggtaacccggttacggaacggggtaacgggtacggaaaaccgtaaacggtaaggtaacctaacccggtaaagttaccgttaacggttccgggaacggggtcctaacgggtaccaacgggtacgtaccggtaccggccgggtaccgtaccgtcgaactacgactacgaaccttacgagtaccgagtacgtacgtacgtcggtacgtcgtaccgtacggtaccgaccgggttaaccgtacccgtagtacccggttacgtacgtttagaccggttagtaagggttaccgggtagttaccgggttacgggtaccgggttacccgggtaccgggtaccggggtacgtaccgtaacccggggaaccgtcgggggaacccgggttaacccgggg

SEQ ID NO: 167924 - DNA, 704 bp, Homo sapiens
  misc_feature: GYAE6OF01B8CHE.40.12.B01.1.454.CMB.1.raw
  modified_base (140)..(140): a, c, t, g, unknown or other
  misc_feature (140)..(140): n is a, c, g, or t
  modified_base (148)..(148): a, c, t, g, unknown or other
  misc_feature (148)..(148): n is a, c, g, or t
  modified_base (167)..(167): a, c, t, g, unknown or other
  misc_feature (167)..(167): n is a, c, g, or t
  modified_base (309)..(309): a, c, t, g, unknown or other
  misc_feature (309)..(309): n is a, c, g, or t
  modified_base (365)..(365): a, c, t, g, unknown or other
  misc_feature (365)..(365): n is a, c, g, or t
  modified_base (537)..(537): a, c, t, g, unknown or other
  misc_feature (537)..(537): n is a, c, g, or t
  modified_base (602)..(602): a, c, t, g, unknown or other
  misc_feature (602)..(602): n is a, c, g, or t
  modified_base (616)..(616): a, c, t, g, unknown or other
  misc_feature (616)..(616): n is a, c, g, or t
tcagtctagcgactcacgaccggtgctcgatttagtagtgtagattcggcgggggagcatcacccagcaaccacatctgtcctctagagaactcccctgagagcctccgttctcaccatggactggacctggagctcctnttcgtggngcagcagccgacgaggacnccctacctccgaggcgagacggtcgtggcgcgacgttcggtgggtctagggaggtacggaaacgcgtccgggtcggggtcccgtttacgggaaggtccgttccgtaccgtaagaactagttagtttaacggacggtaaaccnccgtaggactactaactactaacggcttaacgcgtgacgtcggccgacgcgtaccnggtagtgggttggagttggacggtcgggataccaccgtaccaggaggtacgactaacgtaagaaggttcactaacggacggttaacgtacgggacgtccgtaagggacctacgaggtaccgtaacggcgggtccgacgtacgaagtcgacgaccaagtacgtactagtaggngtacgagtacgacggtcgtaccgtacgtaccgtaccgacgttacgacggaccgtcgaaacggttnttacgtaaaccggngttaaaacgggcggttaaagggtcggttggggaccccggtcggaacccgggtgaaccggttacgaccggcggggtcggtaaccccggg

SEQ ID NO: 167925 - DNA, 909 bp, Homo sapiens
  misc_feature: GYAE6OF01CP4DW.40.12.B01.1.454.CMB.1.raw
  modified_base (182)..(182): a, c, t, g, unknown or other
  misc_feature (182)..(182): n is a, c, g, or t
  modified_base (193)..(193): a, c, t, g, unknown or other
  misc_feature (193)..(193): n is a, c, g, or t
tcagtctagcgactcacgaccggtgctcgatttagtagtgtagattcggcgggggagcatcacccagcaaccacatctgtcctctagagaatcccctgagagctccgttcctcaccatggactggacctggaggatcctcttcgttggtggcagcagccgcaggacgcccactcccgaggtncagcgtggtcncgagtcgtggggctggaggtgaagagcgtgggcctggtagaacggtctccgtgactaagtagttactacggaaaccacccgttgaacgacctaaactactaacctataaccacgttggaagtcggccggtaccgacggtccccgtagggaacggtacggggtttacggtaagggtcgggtagttaggggggttacgtaccgtaaacccgtaaaccccgttaaccggaacggtacgggtacggtaaaccgtaaaaccggtaaaaaggtttaccgttaacgggaaacccgttaaacggtttaaaacccgtttttacccgggaaacgggggtaacccggttaacgggggttaccccaaaacccggttaacggttaacccgggtaaccccgggttaacgggggtaaccccgttcccgggtttaaaccccgaacgtttacccggaaaccggttaaaccgtacccggttaaccgggttacgtttaaacccggtaacggtttacggggtacctttacgggtacccgggtaaacgggtacccgggttaaccgttaaccgggtacccctttaacgggtacggtaaacccggtacccgaacccgggtacctaacggttacggttacccgttaaaggtccggtaaagggtaacgtacggttacggtggggtaccggtagtaccccgggtgggtaccttaccgggccgtaacgggtcgggaacccggg

SEQ ID NO: 167926 - DNA, 155 bp, Homo sapiens
  misc_feature: GYAE6OF02IUT8L.40.12.B01.1.454.CMB.1.raw
  modified_base (128)..(155): a, c, t, g, unknown or other
  misc_feature (128)..(155): n is a, c, g, or t
tcagtctagcgactcacgaccggtgctcgatttagtagtgtagattccgcgggctggcaaggcgcatagctgcctggtcaaggactacttccagtcgctagactgagcgggctggcaaggcgcatagnnnnnnnnnnnnnnnnnnnnnnnnnnnn

SEQ ID NO: 167927 - DNA, 223 bp, Homo sapiens; identical to SEQ ID NO: 167890
  misc_feature: GYAE6OF02I3VIB.40.12.B01.1.454.CMB.1.raw
  modified_base (221)..(223): a, c, t, g, unknown or other
  misc_feature (221)..(223): n is a, c, g, or t

SEQ ID NO: 167928 - DNA, 517 bp, Homo sapiens
  misc_feature: GYAE6OF02FT889.40.12.B01.1.454.CMB.1.raw
tcagtctagcgactcacgaccggtgctcgatttagtagtgtagattccgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgacccgtctctgggctccaggctgaagatgaggctgattattactgctactcgtatgcaggcgcaacagttgggtcttcggcggaggaccaagctgaccgtctaggtcagcccaaggctcgcccctggtccactctcgtcccgccc

SEQ ID NO: 167929 - DNA, 534 bp, Homo sapiens
  misc_feature: GYAE6OF02GNGIS.40.12.B01.1.454.CMB.1.raw
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctcaagtctggcaacacggcctccctgacccgtctcgtgggctccaggctgaagatgaggctgattatactgctactcgtatgcaggcgacaacaagtttgggtcttcgggcgggagggaccaagcgtacgaccgttcgtaggtcacgcccgaaggcctcgccccctggtccactctcgtcccacccc

SEQ ID NO: 167930 - DNA, 591 bp, Homo sapiens
  misc_feature: GYAE6OF02ILA9F.40.12.B01.1.454.CMB.1.raw
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
  modified_base (420)..(420): a, c, t, g, unknown or other
  misc_feature (420)..(420): n is a, c, g, or t
tcagtctagcgactcacgaccggtgctcgatttagtagtgtagattccgcgggggggtcgtcgaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctccngcactggaaccagcagttgacgttggtggttanaactatgtctctggtaccaactacaccaggcaaagccccaaaactcatgattctgacgtcagtaagcgcctgagggtccctgactcgcttctctggctacaagtctggcaacgcggcctccctgaccgtctcgcgggactccaggtctgaagtatgagtctagtattattacngtacttatcgtattgcagggcgacaaacagttgggttcttcggacgggacgggacaaggtcgacgacccggttcacgggttacaaccggacccgaaagggttcctacccgggtcccccccttcggggtacctaacccgttccgtttacccggttacccccttaacccccgg

SEQ ID NO: 167931 - DNA, 221 bp, Homo sapiens
  misc_feature: GYAE6OF02FVD3N.40.12.B01.1.454.CMB.1.raw
  modified_base (221)..(221): a, c, t, g, unknown or other
  misc_feature (221)..(221): n is a, c, g, or t
tcagtctagcgactcacgaccggtgctcgatttagtagtgtagatttgacttctggggccagggaaccccggtcaccgtctccgcagcctccaccaagggcccatcggtcttcccctggcgccctgctccaggagcacctccgagagcacagcggccctgggctgcctggtcaaggactacttccagtcgctagactgagcgggctggcaaggcgcatagn

SEQ ID NO: 167932 - DNA, 531 bp, Homo sapiens
  misc_feature: GYAE6OF02JFJAG.40.12.B01.1.454.CMB.1.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaacgcccccaaatcatgatttcngacgtcagtaagcggccctcgaggggtccctgatcgcttcnctggctccagtctggcaacncggcctccngaccgtctcgtgggcctccgagctgaagntggagctgtattattactgctactcgtatgcagggcgacaactagttcgggtcttcgggcggaggaccagctgaccgtcgaggtcacgccaaggcctcgcccccgtggtaccactcgtccgttcccgccc

SEQ ID NO: 167933 - DNA, 530 bp, Homo sapiens
  misc_feature: GYAE6OF02GQ3RK.40.12.B01.1.454.CMB.1.raw
  modified_base (302)..(302): a, c, t, g, unknown or other
  misc_feature (302)..(302): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcatcatctcctgcactggaaccagcagtgacgttggtggttataactatgtctcctggtaccaactacacccaggcaaagcccccaaactcatgatttcngacgtcagtaagcggccctgaggggtccctgatcgcttctctggctccaagtctggcaacacggcctccctgaccgtctctgggctccgaggctagaagatgaggctgattattactgcttactcgtatgcgaggcgacaacgtagttgggtctttcgggcggaggaccaagctcgaccgtcgtaggtcacgacccgaaggctcgcccctggtccactctcgtccccg

SEQ ID NO: 167934 - DNA, 540 bp, Homo sapiens
  misc_feature: GYAE6OF02I1IHX.40.12.B01.1.454.CMB.1.raw
  modified_base (352)..(352): a, c, t, g, unknown or other
  misc_feature (352)..(352): n is a, c, g, or t
  modified_base (485)..(485): a, c, t, g, unknown or other
  misc_feature (485)..(485): n is a, c, g, or t
  modified_base (536)..(536): a, c, t, g, unknown or other
  misc_feature (536)..(536): n is a, c, g, or t
tcagtctagcgactcacgaccggtgctcgatttagtagtgtagatttcgcgggcacgaccggtgctcgatttagtagtgtagattcgcggggagagcatcacccagcaaccacatctgtcctctagagaatcccctgagagctccgttcctcaccatggactggacctggagatcctcttcttggtggcagcagccgcaggagcccactcccaggtgcagctggtgcagtcgtggggctgaggtgaagaagccgtggggcctcggtgaaggtctcctgacaagtatttcaggaaaccacctgagcaactactacatacactggatgcgcacggccctaggacgtaggggttnaggtggagtggggtagactccgaaccctacgaggtacggtggaccaacgaaagtactacgaacacgtaactttcgacgggtacgacgggtacacgtatcgaccgtgggaccgcgtccatcagcactgtcctanagttggatcgagacggcggcgtcgactacgcgacgacgacgcagtcgtatntagg

SEQ ID NO: 167935 - DNA, 614 bp, Homo sapiens
  misc_feature: GYAE6OF02I1NSG.40.12.B01.1.454.CMB.1.raw
  modified_base (511)..(511): a, c, t, g, unknown or other
  misc_feature (511)..(511): n is a, c, g, or t
  modified_base (569)..(569): a, c, t, g, unknown or other
  misc_feature (569)..(569): n is a, c, g, or t
tcagtctagcgactcacgaccggtgctcgatttagtagtgtagatttcggtcggggcgtagacttggtcgtttcgtcgtagtcctcccgtgacgtcagtcctccgtggggctgctaagtgcgtctgggtctacgtggatccaggtggggatattgtgatgactcagtctccactctccctgcccgtcactcctggagagccggcctccatctcctgcaggtctagtcagagccctacctaaacactaagtggaatactactctttgaatttggtacctgcagaacgccagggcagtctccacagcttcttgatagttagtttgggggttctttagtccggggtcccgttccgggggttccccttaggtaccgtaaggggtttccaagggttcgggaccaggttggggaacttccgaggttcactaagtactttttacaactagaaaatccgagcgagggtggaggcaagaagagtgggtaggtatttattacgtgcatgactactactaanaactgtagtcggacggtcggacgaaggaccgaaggtaggaactagagacgtaagtggnggcgtgacctacacgttcgtacgttcctactacttccgttccccg

SEQ ID NO: 167936 - DNA, 880 bp, Homo sapiens
  misc_feature: GYAE6OF02GSK9D.40.12.B01.1.454.CMB.1.raw
tcagtctagcgactcacgaccggtgctcgatttagtagtgtagattcggcggggtgatcaggactcctcagttcaccttctcactaatgaggctccctgctcagctacctggggctgctaatgctcgtgggtctctggactccgtagtggggatattgtagatgactcagtctccactctcccgtgcccgtcgactccgtggagcgcccgggcctccgatcctcctgcctacggtcctagtcagacgccctacctaaacacttaactggaacttaacttaccttcgttttagaactttcgggtaaccctggtacgacggaacgtccggaacgggctaacggttcctacccgaacacggtcctttaccgttaggtaattaacgtttaaggttttcgggggtttacctttaacggtccggggtccccgtttacccgggggttaccccttaggtaaccgtacgggtttacctaacgggttcgggtaccgtaaggttacgggtaacgttaccggaaacggttcccgtaaacgtacggttaacgttttttaacccgaaccgtttaaacggaaaaaacgttaccgtaaacgggtacccggtaaaggggggttaccgggaacgggtaccgtaaaggtaaacgttacgttagggtttaacggggttaacgttttaacgtttaaccggtacggtaacgtaacgttaccggtaacccgttaaacccgttaccgttaaaccgttaaaccggtttcggttaacggtttacggggtaaccgggttaccgggtaaccggtaaaccggggtaaccgtaaaggggttaacggtaaaccggttacggtaacggtaccgtaacggttaccggttagggcgttacggaccgttaacccg

SEQ ID NO: 167937 - DNA, 619 bp, Homo sapiens
  misc_feature: GYAE6OF02GRB4J.40.12.B01.1.454.CMB.1.raw
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
  modified_base (402)..(402): a, c, t, g, unknown or other
  misc_feature (402)..(402): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttanaactatgtctcctggtaccaactacacccaggcaaacgcccccaaatcatgatttcngacgtcagtaagcggccctcgaggggtccctgatcgcttctctgctccaagtctggcaacacggcctcctgaccgtctcgtcgggctccgaggctagaagngtggaggctgtattacttactgtctacgtcgtatgcaggcgacaacgtaagtttcgggtacgttcgggacggaacgggtaccaaggtccgtacggtacccgttaccgttacgggtaccaaccgggtaccccgtaaacgggtcccgttacccgggtcccccccggttccgggttacccgtacccgtttcccgttcccgggtttaccccccgtcccccg

SEQ ID NO: 167938 - DNA, 560 bp, Homo sapiens
  misc_feature: GYAE6OF02IM6YF.40.12.B01.1.454.CMB.1.raw
tcagtctagcgactcacgaccggtgctcgatttagtagtgtagattcacgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccaggcagtctccacagctcttgattatagttggggttcttagtccgggtccgtccggggtccctgacgtaggttcaggtggcagtggatcagtcactagtatttacactagaaatcgagcagggtggaggcaagaagagttggttggtatttagtatgcagtagcaacctctaacaacgtgtggtacgggacggtacggaccgaaagggaccgtaaaggtacggtaaactacgaacgacgtaacgtggtacggctcgaccacctacgttctcgttccttactaccgttccctcccg

SEQ ID NO: 167939 - DNA, 623 bp, Homo sapiens
  misc_feature: GYAE6OF02GVFXS.40.12.B01.1.454.CMB.1.raw
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactntgtctcctggtaccaactacaccaggcaaagcccccaaatcatgatttcngacgtcagtaagccggcctcgaggggtccctgatcgcttctctggctccaagtctggcaacacggcctcctgaccgtctcgtcgggcctccgaggctagaagtatggagtctagatttattactgctactcgtatcgcgtagggccgacaaccgtaaggttcgggtacgttacggggaccgggtaagggacctaaaggccgtacgtacccggttccgttaacgggtccaaccggtaccccgtaaagggtccccttacccggtacccccccgttggggttacccctaccggtttacccgtttcccggttaccccccggtcccccg

SEQ ID NO: 167940 - DNA, 572 bp, Homo sapiens
  misc_feature: GYAE6OF02HCKHX.40.12.B01.1.454.CMB.1.raw
  modified_base (300)..(300): a, c, t, g, unknown or other
  misc_feature (300)..(300): n is a, c, g, or t
  modified_base (353)..(353): a, c, t, g, unknown or other
  misc_feature (353)..(353): n is a, c, g, or t
  modified_base (397)..(397): a, c, t, g, unknown or other
  misc_feature (397)..(397): n is a, c, g, or t
tcagtctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaactacaccagcaaacgcccccaaactcatgtatttcngacgtcagtaagcggccctcgacgggtccctgatcgcttctctgctccagtcngcacgacgcctcctcgacctctcgtcgggctccgagctagaagntgagctagtattatactgtctacgtcgtatgacgacggcgactaacgtagttgggttcgttcgggacggtaagggaccaagtccgtacggtacccgttccgtaggtccaacgacccggaagtccgtcccgtcccccgtcggtacctccgttccgttacccgttccccgtcccccg

SEQ ID NO: 167941 - DNA, 717 bp, Homo sapiens
  misc_feature: GYAE6OF02JSEZE.40.12.B01.1.454.CMB.1.raw
tcagtctagcgactcacgaccggtgctcgatttagtagtgtagattcggcgggggagcatcacccagcaaccacatctgtcctctagagaactcccctgagagctccgttcctcaccatggactggaccgtggaggatcctcttcgttggtggcagcagccgcgaggacgcccactcccaggtgcagctggtgcagtcgtgggctggaggtgaagagccgtgggcctggtgaggtctcctgacagtattcgaggaaaccaccgtgacgacaactactacaatacacgtggatcggccggcgaccggtccccgtagggaccgttaggggtttcgaggtggtacgggtggggtagaacttacccgaacccgtacgaggacggtcggactaacgtaaagtacgacgaacgtacgtaacgttcgaacgggactacgggtaccacgtacgtcgacccgtagggaccgtccggtaaccacgtcgacgtaccaacgtacgttaccgaacgtagtacggtacttcgtaggacggttacggacgttacggacccgtacgtacggaccgtaaccgccgtacgtaacgttacgttaaccgtgtacgggtaacgggtaaacggtaaccgggttacgggttacgggtccggtaaccccggtcccgggggtaaccgggtaccgttacccgggtaaccccggttacggggtaccccggggttaaacccgggg

SEQ ID NO: 167942 - DNA, 684 bp, Homo sapiens
  misc_feature: GYAE6OF02HYU41.40.12.B01.1.454.CMB.1.raw
  modified_base (187)..(187): a, c, t, g, unknown or other
  misc_feature (187)..(187): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (602)..(602): a, c, t, g, unknown or other
  misc_feature (602)..(602): n is a, c, g, or t
tcagtctagcgactcacgaccggtgctcgatttagtagtgtagatttccggtcgggggggggtctcagggaaggcacgcgcctctcaggtaccgtcacctaccattgggcctgggctctgctctacctcacctcctcactcagggctacgaggtcctgggcccaggtttcctgccctgaacttacgngccctccgtcgcgtacgggtctcctggtacagtcagttcgaccatcgtcctgccacggtcgaaccagcagtcgacgttggngttanactntgtctctgtacctaatacnccagcaaacgccccaaaatcatcgattctgtacgtcaggtaacgcgtccctggacggttcctgtactcgtacttactcgtacgtctacgtacgtctaggctaaacgccggtacctaccgtacgtaccgttccttcgtacgggtaccttaccgagggtccctaggaacgtacgtacggacggacttcgaatttacgtaacttaccgtcgtttactacgtatcgaactaacggcgaactaagtaagttcgggtaactcgggacgaacgggtaacccaagggtccttacggtacccttcgtacggttanaaaccgggttaacccgaggttacccgttccgaacccccggttagttaccctaaccggtttccttacccggttacccgtcccc

SEQ ID NO: 167943 - DNA, 652 bp, Homo sapiens
  misc_feature: GYAE6OF02G2GT1.40.12.B01.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (432)..(432): a, c, t, g, unknown or other
  misc_feature (432)..(432): n is a, c, g, or t
tcagtctagcgactcacgaccggtgctcgatttagtagtgtagattccgcgggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatctctgcacgtggaaccagcagtcgtacgttggtgttataactntgtcctcgtcggtaccaactaccaccgaggacaaacgaccccaaactcatgtacttcgtacgacgtacgagtaacgccggccctcggacggggttcctcggtactcgtcttctcgtcggtcctacgacgtcgtacgacaacgccggtcctccgtcgtaccgtctcggtcgggtcctaccgngtcgtaggaacgtgtaggacgtcgtagtattaacttcgtcgttactcgttacgtagtcggcgacgggacgaacgtaacgttacggttcgggttccggtaccgggacgggtaacggaccgaacggtctacggtacccgtaccggtacggtaccgacggacccggtacggtcccgtcccggtacccggtcgttaccttccgtccgttcccgtcccgtccccg

SEQ ID NO: 167944 - DNA, 906 bp, Homo sapiens
  misc_feature: GYAE6OF02FREP4.40.12.B01.1.454.CMB.1.raw
tcagtctagcgactcacgaccggtgctcgatttagtagtgtagatttcggcgggggtgatcaggactcctcagttcaccttctcacaatgaggctccctgctcagctcctggggctgctatgctctgggtctctggatccaggtggggatattgtgatcgactcagtctccactcctccctgcccgtcactcctggagcggccgcctccatcctctgcaggtctagtcagacgtcctacaaaccataagtcggaattactacgtttctttagtaacgtttcggtaccttggacaacggaacgccggaggggcctacggtcccttacccaaccgacgtcctttacgtttcgtaattagttttagggttttaccgggggttttaccttttacgggtccccgggggttccccgggtttaccccgggggttaccccttacgggtaaccggttaccggggttttacgtaacgggttcggggtacgttaacggggtgggtaccttacggttaaaccggttaacccaacgtttaacggtttaactttttaaccggaaacgtttaaacgttaaaacggttacgaaacggtacggggtaaggggggttacgggaacggaacggtaagggtaaaacggtagttttaagggggttttaagggttaacggtttttaacgtttaaccgtcggtaacgttaccgggttaccgtaacccgttaaacccttacccgtttaaaaccgttaaacggttcggggtttaccggggtaaccggggttacccggggttaccgggtaaaccccgggtaaacggggggtaaaccggtaacgggggtttaaaggaaacccggttaaccggaaccgggtacggttaaccgggttgggttaccgggttaaccggtccggtacccgtaacccgg

SEQ ID NO: 167945 - DNA, 730 bp, Homo sapiens
  misc_feature: GYAE6OF02HTN72.40.12.B01.1.454.CMB.1.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
tcagtctagcgactcacgaccggtgctcgatttagtagtgtagattccgcggggggggggtctcaggaggcagcgctctcaggacgtcaccaccatggcctgggctctgctcctcctcaccctcctcactcgagggcacagggtcctgggcccagtctgccctgactcagcctccctcgcgtccgggtctccgtggacagtcagtcacntctcctgcactggaaccagcagtgtacggttggtgttataactntcgtctcctggtaccaactaccaccaggacaacgacccccaaactcatgtatttctgacgtcagtaagccggtaccctcgtaccgggtcctgtactcgtaccttctcgtcggtcctaccgtaagtcgtacggacctaacgaccggtccctcccgtacgtacccgttcctcggtacgggcctcggacggtcgtacgacggtacgtaggtagtccgtagtaacttttaacgttacgttccggtaacgtttaccgttacgtttaaccgtcggtaccggtaacggggtacccggtacctaaacgggttaacgggtttcgggttaccggtttccggggagggtacccgggaacgtacggtacggtaccggttacccgtaccggtacgggtccgtacccggtaaccggtaccgtcccggttcccgtacccccgggttccggttccctaccggtttcccgtccccggtttaccccctaccccgg

SEQ ID NO: 167946 - DNA, 817 bp, Homo sapiens
  misc_feature: GYAE6OF02JMZJC.40.12.B01.1.454.CMB.1.raw
  modified_base (256)..(256): a, c, t, g, unknown or other
  misc_feature (256)..(256): n is a, c, g, or t
  modified_base (373)..(373): a, c, t, g, unknown or other
  misc_feature (373)..(373): n is a, c, g, or t
  modified_base (387)..(387): a, c, t, g, unknown or other
  misc_feature (387)..(387): n is a, c, g, or t
tcagtctagcgactcacgaccggtgctcgatttagtagtgtagattccgcgggggggggtctcaggaggcagcgctctcaggacgtcaccaccatggcctgggctctgctcctcctcaccctcctcactcagggcacagggtcctgggcccagtctgccctgactcagccctcctcgcgtccggtctcgtagacagtcagtcaccatcctctgcacgtaggaaccagtcagtcgtacgttggtagttaataacgtntcgtccttaccgtggtaacccaaactaccacccgaaggaccaaaaccgtcccccaaactcagttgttaactttcgtacgacgttacaagtacgccggtccctcggaacgggttcccngtactcgtctttcncgtcggtccacgtaacgtcgttcggaaccctaacgcccggtcccttccgtaacggaccgttccgtaccggtcgggtcctaccgtacggtacgttaacggaaagtcgttaacgggacgtacgttacgtacgttttaactacgttcgtacgttaccgtacgttaagtcgttacggaacgggaccggtaaccgtaaaaccgtttacgggtttaccgggtttaccgggttaccggggtaaccgggtaaccggggtaaacccgtaccgggtaaccgttacccgggttaacccgttacccggttaccggtaacccggtaccgggttaacccggtaaacccgggttccccgtacccgggttaaccccccggtttacccgggtaacccttaccccggtttaccccggtttaccccggttacccccgttaaccccccgg

SEQ ID NO: 167947 - DNA, 582 bp, Homo sapiens
  misc_feature: GYAE6OF02IKOXF.40.12.B01.1.454.CMB.1.raw
  modified_base (169)..(169): a, c, t, g, unknown or other
  misc_feature (169)..(169): n is a, c, g, or t
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (520)..(520): a, c, t, g, unknown or other
  misc_feature (520)..(520): n is a, c, g, or t
tcagtctagcgactcacgaccggtgctcgatttagtagtgtagattcgcgtggggagcatcacccagccaaccacatctgtcctctagagaatcccctgagagctccgttcctcaccatggactggacctggaggatccttcttcttggtggcaagcagcccgcaggcncccactcccgaggtncagctggngcagtcgtggggctggaggtcgaaggagcctggggccttagggngaacggtctccnggctaagctttcacggaaacncctgancaactacacatacacgtggatgacgacgcgccgtggaacgtggggttgagtgtagnggggtagatccgaactacgagaggtcgacacaagtncgacagtaattacgaggtacgcgggtanaccgtatcggacgtggacgtacnccgtaatcacgacctacncgtaaccgtagacgtagatcctaaggcgttaccggntactacccgttnacggacgaaccgacgtccgtaattcgtattaccggnggtacggtaagctcgggttaggcgaccgttacgggccggctaacggtaccgcggttaacggg

SEQ ID NO: 167948 - DNA, 704 bp, Homo sapiens
  misc_feature: GYAE6OF02IUP3N.40.12.B01.1.454.CMB.1.raw
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
tcagtctagcgactcacgaccggtgctcgatttagtagtgtagattccgcgggggggggtctcaggaggcagcgctctcaggacgtcaccaccatggcctgggctctgctcctcctcacccttcctcactcagggcacgagggtcctgggcccaggtctgccctgactcacgccctccctccgcgtccgggtctcctggacagtcagtcatcatctcctgcactaggaaccngcagtcgtacgttggtggttataactntgtctcctagtaccaactacaccagacaaacgaccccaacnctagtacgtactttctacgtacgtacaacggttacgccggtacccgtcgacggggttccctagtacgtccgtctttactcgtcgacctacgaacgttcgtcgaccgacgtacccggtcctaccctcgtacccgtctccggtacgccgtaccgacggtactacggaagtcgtacggaggtactacggttacgtttaattaccggtagttaccttaacgttacggttatccgacggtacggtacggtaacctaaacgttaacggtttcgggttacttaccgggggacgggacgttaaacccggagttccgtacgtaacccggtcggttaacggacctaacgggaccctacggtacccgtcccggtaaccccgtggttaccctaccgtttccgccccgttacccccg

SEQ ID NO: 167949 - DNA, 691 bp, Homo sapiens
  misc_feature: GYAE6OF02FMQNI.40.12.B01.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (432)..(432): a, c, t, g, unknown or other
  misc_feature (432)..(432): n is a, c, g, or t
tcagtctagcgactcacgaccggtgctcgatttagtagtgtagattccgcggggggggggtctcaggaggcagcgctctcaggacgtcaccaccatggcctgggctctgctcctcctcaccctcctcactcagggcacagggtcctgggcccagtctgccctgactcagcctcctcgcgtccgggtctcctggacngtcagtcaccatctcctgcactggaaccagcaagtgacgttggtggttataacgtatgtctctggtaccaactacaccaggcaaacgccccaaactcatgatttcgngacgtcagtagccggccncgcggggtccctgactccggtcttctcgnggctccaagttctcggacaacgaccggccctacccgtcgtacccgttcgtacgtcgggtctcccgagggtcctaggaaacgngtacggagggtacctagtaacgtttaacgttaccgttacgtacgttaccgttacgttacgtcgaaccgtagggaccggaccgtaaacgtacggttttaacggggttccgtttacggggcgggtaacgggaacctaacggtaccgtcgggtacccgttaccgtaacggttccggaaccgtacccggaaacggttcccgtaacccggtccccgtttaccgggtaacccttcgtacccgtttaccggtcccccttaaccccg

SEQ ID NO: 167950 - DNA, 237 bp, Homo sapiens
  misc_feature: GYAE6OF02JAKFV.40.12.B01.1.454.CMB.1.raw
  modified_base (214)..(214): a, c, t, g, unknown or other
  misc_feature (214)..(214): n is a, c, g, or t
  modified_base (219)..(237): a, c, t, g, unknown or other
  misc_feature (219)..(237): n is a, c, g, or t
tcagtctagcgactcacgaccggtgctcgatttagtagtgtagatttgacttctggggccagggaaccccggtcaccgtctccgcagcctccaccaagggcccatcggtcttcccctggcgccctgctccaggagcacctccgagagcacagcggccctgggctgcctggtcaaggactacttccagtcgctagactgagcggctggcaaggcnatagnnnnnnnnnnnnnnnnnnn

SEQ ID NO: 167951 - DNA, 828 bp, Homo sapiens
  misc_feature: GYAE6OF02G4EHT.40.12.B01.1.454.CMB.1.raw
  modified_base (272)..(272): a, c, t, g, unknown or other
  misc_feature (272)..(272): n is a, c, g, or t
  modified_base (319)..(319): a, c, t, g, unknown or other
  misc_feature (319)..(319): n is a, c, g, or t
tcagtctagcgactcacgaccggtgctcgatttagtagtgtagattcggcgggggtgccctgagagcatcacccagcaaccacatctgtcctctagagaactcccctgagagctccgttcctcaccatggactggacctggaggatcctcttcttggtggcagcagccgcaggacgccccactcccgaggtgcgagcgtggtgcagtcgtggggctggaggtagaagacgtccggtcggggcctgggtaggacggttctccgagacaagttntttacgacgaaacctcctggacacaactactacactaacacgtggancggccggacgaccgggtccccgtgggacggttaaggggttggtacggtagggtacggttgggggtacgacctaacccgaacccgtaacgagggtacgggtacgacgtaaacggtaaagttacgtacgaacgtaagttaccgtttcgggaacgggtacggtaaccggtacctaaccggtaagtaccgggtaccgggttaccgggacccgttacccggtacccgtagtacccgtaacggtacccgtaacggtaacccgttaccgtaacgtacgttaccggggttaccttacggttaaccgggggaccggttaaacccggggttacccgtttaccccgggttaacccggttacccggttaaccgggaaaccggttaaccccgggaccgggtacctttaagtttccggttaaacggtttaccggtaggggtaaccggtaaagggttcggttacggggtttacggggtccgggtaacccgggtcccgggggtaccggttacccgaacccggggg

SEQ ID NO: 167952 - DNA, 867 bp, Homo sapiens
  misc_feature: GYAE6OF02GEHB1.40.12.B01.1.454.CMB.1.raw
  modified_base (169)..(169): a, c, t, g, unknown or other
  misc_feature (169)..(169): n is a, c, g, or t
tcagtctagcgactcacgaccggtgctcgatttagtagtgtagattcgcagggggagcatcacccagcaaccacatctgtcctctagagaactccctgagagctccgttcctcaccatggactggacctggaggactcctcttcgttggtgacagcagccgacaggacncccactccgaggtcgcagcgttggtcgctacggtcgtgggggctaggagggttaggaaacggtacggtccgggtacgggggtcccgttagggtaacggtacgggttcctaccgttacggaactaaacgttacgttttaccggaacggtaaaccctaccggttgaacggtacttaaaccgtaacctaacgacttaccgacgttagtaccgtcggaccggtacgtacccgtaccccgtgggaacgggtttacgggtttacggacgggttacgggtacgggttcggggttacgtaacttaacccgaacccgttaacggtcgggtacggttacggaaccgtaaacggttaacggtacgtaaccggaaacgttaacggtttaaccgtttcgggaaaccggggtacggttaacccgggtaaccgaccgtaacggttaacccggtaccgggtaccgggtaaccgttacccggttacgaaccgttcggaaccgtaccgtaactaaccgggttacctaacggttacgtacggttacgtaccggtacgggaacggtaccggtaacgttaccgtaacgtacccggtagtacccgtaacgtacccggtactacgttaacgtaccggttacgtacgggtacgaacgggtacgttagggaaccgtcggtaccggtacggtaccggtcggttaccgaccggtcgtaaccgggg

SEQ ID NO: 167953 - DNA, 711 bp, Homo sapiens
  misc_feature: GYAE6OF02G9HH5.40.12.B01.1.454.CMB.1.raw
  modified_base (198)..(198): a, c, t, g, unknown or other
  misc_feature (198)..(198): n is a, c, g, or t
tcagtctagcgactcacgaccggtgctcgatttagtagtgtagattccgcggggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacngtcgagtcaccatcctcctgcactaggaaccagcagtgacggttggtaggttaataactagtcgtctcgtacggtaccaactaccaccgagaccaaaccgaccccaaatcagtgtacttcgacgtacgtacgtaacgtaacggccggtaccccgtacggtaccggggttaccctaggtacgttccgtccgtttccgtacgtcggtcccttaaccggtaacgttccggtacggaacccgtaacggtaccggtccccgttacccgtacgtaccccggttcgtaccggttcgggtaccttaccggagggtccgtaaggtaacgtgtacggcggttactgtaattaccgttacgtataccgttacgtacgtgtcgacggtacgcgtaacacggttagtcgggttacgtcgggtaggaccggtacaacggtcgtaccggtacgtccgttaacggccaacgtccggtaagcccggtacggtaccctacggtcccgtaccgtccgttccgtccccgtccg

SEQ ID NO: 167954 - DNA, 640 bp, Homo sapiens
  misc_feature: GYAE6OF02FXXBU.40.12.B01.1.454.CMB.1.raw
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
tcagtctagcgactcacgaccggtgctcgatttagtagtgtagattccgcgggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccntctcctgcactggaaccagcagtgacgttggtgttataactntgtctcctggtaccaactacaccaggacaaacgcccccaaactcatgatttctgacgtnagtagcggccctcgacgggtccctgactcgtcttctcgtcggcctcgaagtcgtcggacacacggtcctccctcgaccgtctcgtcgggcttccgaggtcctggaagtatacgggagtcgtgtaatttactacttcgcgttactcgtatcgtcgacgggtcgtacaacgtaaggtttcgggtccgttcgggaccggacgggtaaccaggtaccgtcgtacccggttaccgtacggttaacgaccggtacccggtaaccggcccgttcccggtacccccgttaccggttacccgtacccgtttcccgtttaccccggttacccctaacccccg

SEQ ID NO: 167955 - DNA, 792 bp, Homo sapiens
  misc_feature: GYAE6OF02I0GNX.40.12.B01.1.454.CMB.1.raw
  modified_base (239)..(239): a, c, t, g, unknown or other
  misc_feature (239)..(239): n is a, c, g, or t
  modified_base (381)..(381): a, c, t, g, unknown or other
  misc_feature (381)..(381): n is a, c, g, or t
tcagtctagcgactcacgaccggtgctcgatttagtagtgtagattccgcgggggggggggtctcaggaggcagcgctctcaggacgtcaccaccatggcctgggctctgctcctcctcaccctcctcactcagggcacgagggtcctgggcccagtctgccctgactcacgccctccctccgccggtccgggtctccgtggacagttcagtccacactcctcctgcacgtaggaaccngctaggtgtacggttggtagttacaactagtgtcctcgtacggtaaccaactaacaccgacgacaaaccgaccccaactacatactacgtttcgacgtaccgtacgtaacgtaacgggtccgcccgtacggtaccgggtccncggtagttccgtcgttccgtacgtcgtaacctaccgacgttccgacgccgaaacccgtaccggtcccgttacctccgtacccggttcctacggtccggtccgtaccggtaccggtaccgtaaaggacgtaacggtcggtaaccggtcgttaaggttagtttaaccctttacggtcgttaaccttcggttacgttacggtcggacggtacgggaaccgtaacggtaaaccgttacggggttacgggttccgggtaacggggaccgggttaaaagggtaccgtaaacgttcccggtaacgggtacccgttacgtacccgggtaacggtcccgggaacccggtcgtacccggttacccggtccccgggtttaacgtccctaccgtttccccggtacccgggttcccctaccccg

SEQ ID NO: 167956 - DNA, 1078 bp, Homo sapiens
  misc_feature: GYAE6OF02GZKK6.40.12.B01.1.454.CMB.1.raw
  modified_base (681)..(681): a, c, t, g, unknown or other
  misc_feature (681)..(681): n is a, c, g, or t
tcagtctagcgactcacgaccggtgctcgatttagtagtgtagattcggcgggggagcatcacccagcaaccacatctgtcctctagagaactcccctggagagcctccgttcctcaccagtggactggacctgggaggcttccttctttcggtttgggtacggcacggaccgtacggacccgcgaacgggacgtcccctaacccgtccccgaaggggttcgaccgacggtccgttttagggggtcgcgttacggtttccggggtgggggtccgttagggaaggggttacggtaaaagggtaaccgggttccccggggttaacggggggcccgtttaccgggggtaacgggttaaccggtttccgttacccggtaaggtaccgtaaaaccggttttagttttaaccggaaccggtaaaacccgtaccccgtaggtaaccgtaaccctaaccgtttaacctaaccgtaacttaaccgtaaccgggtttacggtaacggttccggggaacccggggaccggttaaccccgggggtcccggttaacggggttaaccgggggtttaaggggggttttacgaggggttacggggttaaccggggttaaggggggttacctaaaccggttaacccccggaacgttaaccgggaaacggggttcgggtaaaccggtaaccggtaaaanaaaacccggtttcgtaaaacggtaaccggtaaacgttttaaccgggtacggtaccggggtaccgggaaccgtttacccaacgggttaacggtacccgggtaaccggggtacccgggaccggttaacccgtaccgtaacggtacccgacgaaccgtacgttacccgtaacttacggacggtaacggtcgtaacgttacggaccgggaccgttacgtacccggttaaccgtacggtaccggtaaccggcgtaacccggaggtttaaccgtacggttaacccgtttaggtacgggttaaccgggtaaggtttacgggttacgggttccggccgggtttaacccgggttaccgggcggtaacccggttacggacccggttacccgggtacggggtacccgg

SEQ ID NO: 167957 - DNA, 830 bp, Homo sapiens
  misc_feature: GYAE6OF02GKXYZ.40.12.B01.1.454.CMB.1.raw
  modified_base (318)..(318): a, c, t, g, unknown or other
  misc_feature (318)..(318): n is a, c, g, or t
tcagtctagcgactcacgaccggtgctcgatttagtagtgtagattccgcgggggggggtctcaggaggcagcgctctcaggacgtcaccaccatgcctgggctctgctcctcctcaccctcctcactcaggcacagggtcctgggcccagtctgccctgactcagccctccctccgcgtccggtctcctggacagtcagtcaccatcctcctgcacgtggaaccagcagtgacggttggtaggttaataactatcgttctccgtcggtaaccaacctacacccgaggaccaaaccgcccccaaatcatcgtatttcngacgtacgtagaacgccggaccctcggaccggggtcctagtctccgtcttcgtcgtcggtcctaccgtaggtccgtaggaccctaaccgccggttcccctacccgtacgtaccccgttccgttcggtcccggggtcctaccgtacgggtacccgttaggaacgtttacggtaggtaacgggtaccgttaggttaaaccgtttttacgttaccgtacggtttaacccttacgtttaccggttagtaccgggaccggttaccgggaccggtaaataaccgggtttaaacgggtttccggggttaaccggtttccggggaaccgggtaaccgggtaaacccggtaacccgttaccgggtaaccggttaccccggttaccggtaaccggggttccctaacccgggtaaccccggtaaccggttcccccggttcccccgtaaccccccgggttttcccggttaaccccgtccccggtttttcccgtttacccccgggttacccccccttccccccgg

SEQ ID NO: 167958 - DNA, 557 bp, Homo sapiens
  misc_feature: GYAE6OF01CN5CC.36.9.A09.1.454.CMB.1.raw
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
  modified_base (549)..(549): a, c, t, g, unknown or other
  misc_feature (549)..(549): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatccctccctgtctgcatctgtaggagacagagtcatcatcacttgccgggcaagtcagggcattaagaaatgatttaggctggtatcagacaagaaaccagggaaacgcccctaagcctcctcatctatggtncatccagtttacaaacgtcgggtacctattaagattcagcggcaggtggatcgtggcaacagtatttcactctacaccatcagcagcctgacagcctagaaagtnttttagactaattattactgttactaacaaagtacttaaccaactttacccctacggttaaccgttaccgggacccgaaacggggtaaccaaagggtcggtaaagtaccaaaaccggtacgtggtacggtaccttagaccacctntcgttacg

SEQ ID NO: 167959 - DNA, 793 bp, Homo sapiens
  misc_feature: GYAE6OF01A913A.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctccctgctgctctggcctcccaggtcgccagatgtgccataccaaatcgacccagtcctccatccctccctgtctgcatctggtaggagacagagtcatcatcacttcggccgggacaagtcgagggctagttaagaaatgtaagtttaggctaggtatcagacaagaaaccgaagggaacgccctaagcctcctcatctatggtgacactccgtagtttaacaaacggtcggggtaccctaagttaaagtacttacgacggccggacgtaaggttaggtaacgttcgtacgggacctaacgtaagttacttttaccaaccttcctacccaaccctacttaccgaacggtaccgaaccggtcccgttacggacccgacggtacccgttaagggtaaaacgttttacgtttttacggaaccctttaaaccgtttttaacgtttaaccgtttacggtttaacccttaaaccgtaaaacggtttaaccttttaaacccgttaaacccgttttaacccccgtttaccgggtttaacccgggtttacccgggaaccccggtaaaaacggggtaaaccccggtaaaagggggttacgggtaaaacgttaacccgtaaaaaccgggtaaccgttacgggtaccgggtaccgttacggtaaccctaacccgttaacgttcccgtttaccgg

SEQ ID NO: 167960 - DNA, 491 bp, Homo sapiens
  misc_feature: GYAE6OF01CV6EU.36.9.A09.1.454.CMB.1.raw
tcagtacgctgtctcacgaccggtgctcgatttagcgagacgcgcagggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagccctaagctctcatctatggtgcatccagtttacaaactggggtcccattaagattcagcggcagtggatctgggcacagatttcactctcaccatcagcagcctgcagcctgaagattttgctaacttattactgtactacaagtattacaattaccctcgtacgttcgaccaagggaccaaggtggaagtacgaaacgaactgtgctagacaccatctacg

SEQ ID NO: 167961 - DNA, 547 bp, Homo sapiens
  misc_feature: GYAE6OF01EQCAN.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcaagaaaccgagggaaacgcccctaagctcctcatctagtggtgactatcctaagtttaacaaaacgtcggggtaccctaattaaaggatttcgaggcggcagtggatcgtggcacagtatttcactctacaccatcagcaagctgcagcctagaattatttgactaacttattactgtactactaagtacttaactacttaccctacgttaccgttcggacctaagggaacctaagggtacggaaagtacgaaaacgacgtaggtacggtctacggacctaactgtcgttacg

SEQ ID NO: 167962 - DNA, 543 bp, Homo sapiens
  misc_feature: GYAE6OF01BNLT4.36.9.A09.1.454.CMB.1.raw
  modified_base (349)..(349): a, c, t, g, unknown or other
  misc_feature (349)..(349): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatcctagtttacaaacgtgggtcccattaagattcagcggcagtggatctggcanagatttcactctcaccatcagcagcctgcagcctagaagtattttgactaacttattactgtactaacaagtacttactaactttaccccgtacgtaaccgttccggaccgtaaaggggaaccctaaagggtacggaaagttaccgtaaaacggaaccgttggtacggtctacggaccaacctagttcgttacg

SEQ ID NO: 167963 - DNA, 566 bp, Homo sapiens
  misc_feature: GYAE6OF01COFR9.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcaagaaaccaggaaacgccctaagctcctcatctatggtgcatcctagtttacaaacgtcgggtaccctagttaagattcgagcggcaagtggatctggacacagtatttcacttctacaccatcgagcagcctgcacgtcctagaagtatttgactaactttattactagtactaactaaagtattaacaactttaccctacggtacgttaccggaccaaacgggaccgtaaagggttacggaaagttaaccgaaaaccggtaacgttcggttacgggaccttacgggacctaaccctagttccgtttaccg

SEQ ID NO: 167964 - DNA, 532 bp, Homo sapiens
  misc_feature: GYAE6OF01AUV2G.36.9.A09.1.454.CMB.1.raw
  modified_base (419)..(419): a, c, t, g, unknown or other
  misc_feature (419)..(419): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaacgcccctaagctcctcatctatggtgcatccagtttacaacgtgggtacccattaagattcagcggcaggtggatcgtggcaacagtatttcacttctaccaccactcagcagcctgcagcctagaagtatttgactaactttattacttntactaactaagtaacttactaacttacccgtcgttaccgtaccggaccgaagggaccgtaaggtacggaagtacaaacgtaacgtggtacggtactcgacacctgttcttacg

SEQ ID NO: 167965 - DNA, 627 bp, Homo sapiens
  misc_feature: GYAE6OF01B85M6.36.9.A09.1.454.CMB.1.raw
  modified_base (314)..(314): a, c, t, g, unknown or other
  misc_feature (314)..(314): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatcgacccagtctccatccctcctgtctgcatctgtaggagacagagtcatcatcacgttcggccgggacaacggtcgagggctaagttaagaaatgtaagtttaggctaggtatcgagacgaagaaaccgagggaacgccctaagcctcctcatctagtgtnactatctaagttaacaacggtcggtacctaagttaacgtattacgaggcggactaggtagtactcgtacgacatacgtacttccactcacctactatacgacgctacggtacctgaccgtacgtcgtaaggtaatttctttacgaacctttaacgtttacttaacttcgtaacttaacgtaaacgttacttaaaccgttaaccgtttacccgtaccggttaacggttaccggaacggtaaacggaaccgtaagggttacgaacgttaacgaaacgtcgtacggtacggtacctacgactacctgttcgttacg

SEQ ID NO: 167966 - DNA, 685 bp, Homo sapiens
  misc_feature: GYAE6OF01BATKC.36.9.A09.1.454.CMB.1.raw
  modified_base (216)..(216): a, c, t, g, unknown or other
  misc_feature (216)..(216): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggnaagtcagggcattagaaatgatttaggctggtatcagcagaaaccagggaaacgccctaagcctcctcatctatggtgcatcctaagtttaacaaacgttcggggtaccctaattaaacgatttacgaaggtcggacctaggttaggactacgttggacactagtacgttttaccaaccttcctaccaacctacttaccgaacgtccaacgtcccgttagaccgacggtaccctaggtaaagttacgtttttacgaaccttaaacttttaactttaacgttacgtttaaccttaaccgtaaagttaaacctttaacctaaactttaaccccgttaccggttaaccggttaccggtaacccggtaaacgggtaacccgtaaaggggttacgggaaacgttaacccggtaaaacgtaaccgttacgggttacggtaccgttacgacccgtaaccgtacgttcgttacccgg

SEQ ID NO: 167967 - DNA, 621 bp, Homo sapiens
  misc_feature: GYAE6OF01DRPXI.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatcgacccagtctccatcctccctgtctgcatctgtaggagacagagtcatcatcacttgccgggcaagtcagggcattaagaaatgtatttaggctggtatcagacaacgaaacgaagggaaacgccctaagcctacctacatctagtggtgcatcctaagtttaacaaacgttcgggtaccctaagttaacgtattcgagcggactaggtggatcgtggacacagtatttcacttctaccactatcagcacgcctgcacgcctaggtaagttatttacgactaactttactttactacgttaccttaaacgtaacgttaactttaaacctaaccgttttaaccccgttacgggtttaaacccggttaacccgaaaccggtaaacggggtaacccgtaaagggggtacggtaaacgtaaccgtaaaacggtaaccgtggtacgtacgtacgactacctattcgttacg

SEQ ID NO: 167968 - DNA, 549 bp, Homo sapiens
  misc_feature: GYAE6OF01DE8YC.36.9.A09.1.454.CMB.1.raw
  modified_base (276)..(276): a, c, t, g, unknown or other
  misc_feature (276)..(276): n is a, c, g, or t
tcagtacgctgtctcacgaccggtgctcgatttagcgagacgcgcgagggggagtcagacccactcaggacacagcatggacatggagggtccccgctcagctcctggggctcctgctgctctggctcccgaggtgccaggtatgtgccattaccaaatgacccagtctccatcctccctgtctgcgatctgtaggagacaggagtcatcatcacttgccgggcaagtcagggcatagaaatgatttaggctggtatcagcagaaacagggaaacnccctaagctctcaagtctaatggtgcatccaagtttacaaactgggtccattaagattcaagcggacagtggatctggcagagtattcactctcaccatcaagctacgcctagccagcctagaacgtattttagctaacttattactgtactaactaagtattaacaactttaccctcgttacgttccggtacctaagggtacccaaaggggtaggaaagttacgaaaacggtaacgttaggtacggtcttaggccaaaccgagttcgttacg

SEQ ID NO: 167969 - DNA, 544 bp, Homo sapiens
  misc_feature: GYAE6OF01BMEWV.36.9.A09.1.454.CMB.1.raw
  modified_base (536)..(536): a, c, t, g, unknown or other
  misc_feature (536)..(536): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcaagaaaccagggaaacgccctaaagctcctcatctatggtgcatctagtttacaaaactcggggtaccctaagttaagtattacaggtcggacaggtggtaatcgtggacacagtatttcactctcaccatcagcagcctgcagccgtagaagtatttgactaacgtttattacttgtactaacaagtacttaactaacttaccctacgttacgttcggaccgtaaagggaaccgtaaggtacggaagtacgaaaacggactagtacggctacgacaacctntcgttacg

SEQ ID NO: 167970 - DNA, 558 bp, Homo sapiens
  misc_feature: GYAE6OF01D27UA.36.9.A09.1.454.CMB.1.raw
  modified_base (370)..(370): a, c, t, g, unknown or other
  misc_feature (370)..(370): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaggtgtccagtgtgacgtgcaactggtggagtctgggggagcttggtccagccgtggggggtccctgagactctcctgtgcagcctctggattcaactttggtagctattggatggactgggtccgccagtctccgaggggaaggggctgggaggtgggtggccaaacagtacgaggggaggtggtaggtaacgaaaaactntggtaggacttcgtggtggccggggcgattccgacatcctcagagaacaacgaccaaaactcactgtatctagacaaagtcggacggcctagagacgtccgagacgacggtctgttgtattattggtgacgagagtattaagacttaacgtaaagtttcggatagtacgttaggtagtagtagtgtac

SEQ ID NO: 167971 - DNA, 692 bp, Homo sapiens
  misc_feature: GYAE6OF01AN6JV.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctatttagaaggtgtccagtgtgacgtgcaactggtggagtcgtgggggagcttggtccagccgtgggggtccctgagactctcctgtgcagcctctggattcaactttggtagcttattggatggactgggtccgccagtctccgaggggaaggggctgggagtgggtcgccaactagtacgagggaggtgggtaggtaacgaaaaactgtagtggacttcgtggtcggccgggggtccgtagttccaaccgtacgttccgtacccgtaacggaacggaacccgtaaacccggaacccgtaaaaaaccctccgaaccgttaggtaaacttaccgtagaacctaaaaggtacgggaccggtccgtaggaacgtaacgtacccgggaacgggaccgtaccgggtcgttaggttagttaagtttacgttggtacggtacggtaaaggtaaggtaagtttaacggaaaccttaacggttaaaaggttttaccggtaagttacgtaacggtttacggttaagtcggtagttgtaacg

SEQ ID NO: 167972 - DNA, 648 bp, Homo sapiens
  misc_feature: GYAE6OF01EHJ8Y.36.9.A09.1.454.CMB.1.raw
  modified_base (285)..(285): a, c, t, g, unknown or other
  misc_feature (285)..(285): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccataccaaatcgacccagtcctccactccctccctgtctgcatctggtaggagacagagtcatcatcacttcgccggcaagtcgagggcaattaagaaatgtaattaggctggtatacagacaaggaaaccgagggaaacnccctaagctcctacatctagtcgtgctactactacgtttaacaacggtcgggtaaccctaagttaacgattacgaaggcggacgtaggtggtaactcgaggaccacgtaagtactttacccacttcctaccaccgtatacgacgcacgtccgtagacccacgtacctaggtaattactttacgactttaaactttacttacgtgtaacctaaacgtaagttaacttaacctaaacgttttacccgtacgggttaaccgttacgggaacccgtaaacgggtaacccggtaaagggtacggtaaaccgtaacggaaaacggtacgttcgggacgtccacgtacccaccttaagtccgtttacccg

SEQ ID NO: 167973 - DNA, 534 bp, Homo sapiens
  misc_feature: GYAE6OF01DNVFY.36.9.A09.1.454.CMB.1.raw
  modified_base (277)..(277): a, c, t, g, unknown or other
  misc_feature (277)..(277): n is a, c, g, or t
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
  modified_base (527)..(527): a, c, t, g, unknown or other
  misc_feature (527)..(527): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggcaagtcaggcattagaatgatttaggctggtatcagacagaaccaggaactccctagctcctnatctatggtcgactatctagttacaacgtcgggtacccattaagntcaggcgcagtggactctaggcacagtacttacactctcacctatcanctacgctgacacgtcctagtaacgttattttcgaacttaactttattacgtacgtactaacgaagttaacttaacttaacttacccgtagttaccgttacgaccgtaacgggaacctagggtacaagttacgaaacgtaacgtgacgtcagacactntcgtacg

SEQ ID NO: 167974 - DNA, 673 bp, Homo sapiens
  misc_feature: GYAE6OF01DY847.36.9.A09.1.454.CMB.1.raw
  modified_base (456)..(456): a, c, t, g, unknown or other
  misc_feature (456)..(456): n is a, c, g, or t
tcagtacgctgtctcacgaccggtgctcgatttagcgagacgcgcagggggagtcgaggacccactcaggacacagcatggacatgagggtccccgctcagctcctggggctcctgctgctctggctccaggtgccagattgtgccatccaaatgacccagtctccatcctccctgtctgcatctgtaggacgacagagtcatcatcacttgccggcaagtcgaggggcattaagaaatgtaagtttacggctaggtactcaagacccaaggaaaacccgaaggggtaaaccgtcccccgtaaaggtcctacccttacgaacttccgtaacgttgggtcgaccacgttacccgtaagttttaaccaaacggttcggggtaccctaagttaaggacttacgaggcggtctaacggtcggtatcgtacggacacgtagtactttcacttcacacctancgaatcacgtccttagctacgtactaggtaagttacgtttcgaacttaaccttagtttaccgtagtaccttaacaaagttactttaacgaacctttacccgtacggttaacgttaacggaaccgtaaacggggtaacccaaaggggttccgaaaaggttaacccgtaaacgtaacgttcggtacggtcgtacgacctaacccgtattcccgttaccg

SEQ ID NO: 167975 - DNA, 574 bp, Homo sapiens
  misc_feature: GYAE6OF01BH8E6.36.9.A09.1.454.CMB.1.raw
  modified_base (366)..(366): a, c, t, g, unknown or other
  misc_feature (366)..(366): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctatagcatgaactgggtccgccaggctccgaggggaagggctgggagtgggtctcatccattagtagtagtagtagttacatatactacgnagactcagtgacgggcattcaccatctccagacgacaacgccaaagacctcactgtactctagactaaagtcgaaacacgaccctggaacgacggacccgaagggaccacggggcttacgggttagttaactttaccgtggttacggacggggtactggtaccgttaattacgtttttagaacgtttggtttacttccccttaaaccg

SEQ ID NO: 167976 - DNA, 850 bp, Homo sapiens
  misc_feature: GYAE6OF01B1XUP.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaccatggaattgggctgagctgggtttccttgttgctatttagaggtgtccagtgtgacgtgcaacgtggtggagtcgtgggggagcttggtcagccgtggggggtccctgagactctcctgtgcagccttcgtgggtactttcctaaacgttttgggtagtcgttagtttagggagttcgggtaccgttcgggggtccccgaccgtaggttcccgttacccggaagggggtaaacggggtccgttagggggtaacggttcggggggttaccggaaccccgaaaacgtaacggttaaaccgggaaggggggtaagggggtttacggggttaaacggggttaaaaaccggtaaaaaaaaaccggtttggttaacggggttaacggggtaacccgtttcggtacggggttcggggacccggggggtacccgtaaacgttttacccgaacccgtaacgttccccgttaacccggaaggtaaaccgaaccgaaacccggtaaaccccgtaaaaaaaccgtcctaacgttacgttaaccgtccgttaaggaacctaaaggtcgggaaccggtaccgtagaacgtaccgttaccggaacggtaccgacgggtcgtaggttattagttagttggtggacggtaaggtaagttaacgtttaacgaacgttaaacgttaaacggttttcggaaggttacggtaccgttagggttaacgttgttaagtcggtttaacg

SEQ ID NO: 167977 - DNA, 634 bp, Homo sapiens
  misc_feature: GYAE6OF01DA462.36.9.A09.1.454.CMB.1.raw
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (620)..(620): a, c, t, g, unknown or other
  misc_feature (620)..(620): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctatttagaggtgtccagtgtgacgtgcaactggtggagtcgtgggggagcgttggtccagccgtggggggtccctgagacctctcctgtgcagcctcgtggattcaacgtttggatctattggatggacgtcggtccgcagtctccgaggggagggctggaggtggtgccaanatacgagggaggtaggtaggtaacgaaaaacgtntggtaggacttcgtggtcgggccggggaccgtatttccgaccctaagtcctaccgagaacgaaccaaccgaaccctaaaactcaacttgtactcgtagacgaaagtcggaccggtcctaggacgtactcccgggaaggaaccgtcgggtcttacgggttagtttaagttagttggtaggacgggtaagtaaggttaacgtttaacggtaacgttaaacgtaaacggtttacggacggtagtacgttaggttanggtagttgttaacg

SEQ ID NO: 167978 - DNA, 776 bp, Homo sapiens
  misc_feature: GYAE6OF01BWIX8.36.9.A09.1.454.CMB.1.raw
  modified_base (221)..(221): a, c, t, g, unknown or other
  misc_feature (221)..(221): n is a, c, g, or t
tcagtacgctgtctcacgaccggtgctcgatttagcgagacgcgcagggggagtcagacccactcaggacacagcatggacatgagggtccccgctcagctcctggggctcctgctgctctggctcccaggtgccagatgtgccatccaaatcgacccagtctccatcctccctgtctgcatcgtgtaggacgacagagtcatcatcacgttcggccgganaaggtcgagggtctaagttaagaaattgtagtttaggcttaggtatcgaagactaacggaaaaccgagggaaaaccgtcccccgtaaagtcccgttaccctactaacgttccgttaagttacgggtacgtaacctacgttaccccgttaaggttttaaacccgaaaccgggttttccggggtaaccccttaaaggtttaaacgtacgtttaccggacgggtaccggtacgtaagggttcggtaacgttcgttacggacctaacgtaaggttacctttaccgaccttccgtaaccaaccgtagtacccgagacccgtagtacccgtaggaccgtacgtacccgtttaggaaacgtttacgtttacgaaccctttaacgtttaacttacgttacgttaaccttaaaccgtaaacggttaacctttaaccttaaaccgtttcccgtacgttaacccggttacggaaaccgtaacgggtaaccgtaagggttacgggtaaacctaacgtaaacggtacgttaggcgtacgtaccgaaccttaccgtagttccgttaccg

SEQ ID NO: 167979 - DNA, 543 bp, Homo sapiens
  misc_feature: GYAE6OF01EG2OK.36.9.A09.1.454.CMB.1.raw
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtggggggtccctgagactctcctgtgcagcctctggattcaactttggtagctattggatggactgggtccgcagtctccgaggggagggctggagtgggtggccaanagtacgaggggaggtggtaggtaacgaaaaactntggtggactcgtggtggcggggcctattcaccatctccagacgacaacgaccaaaactcaactgtatctgacaaagtggacggcctagagacgtccgaggacgacggtctgttgtattagttgtgcgagagtagttagacttaacgtaaagtttcgagtgtactaggtatgatgtac

SEQ ID NO: 167980 - DNA, 523 bp, Homo sapiens
  misc_feature: GYAE6OF01DOPTL.36.9.A09.1.454.CMB.1.raw
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (407)..(407): a, c, t, g, unknown or other
  misc_feature (407)..(407): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggcaagtcagggcattagaaatgattaggctggtatcagcagaaccagggaacgcccctaagcctcctcatctatggtgcatccagtttacaacgtgggtaccattagattcgagcggnagtggatcgtggcatagtattcactctcaccancagcagcctgcacgcctgaagtatttgactactttattacgtntactacaagtacttaactaactttaccctgttaccggttccgaccgtaaacgggacgtaagggtaggaacgtacaaaacggtacctggtacggtactacgacctaccatcgttacg

SEQ ID NO: 167981 - DNA, 651 bp, Homo sapiens
  misc_feature: GYAE6OF01DEPKO.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacgtgccgggcaagtcgagggcataagaatgtatttaggctggtatcagacaagaaaccgagggaacgcccctaagcctcctcatcgtagtggtgactacttacctaaggtttaaccaaaaccggttcggggttacccaaagtttaacgtaacgttacgaacgggccggtacgaaggttacgggtaactcgttcgggactaacgtaagttactttaccacttccctaccaacctaacgtcaaggacctacgtccgtcgacctacggtaccttagtaaagttattttacgaacttaactttagtaactgttaactaacgtaaagttacttaactaaccgtttaccctacggttaccggtaccggtacgaaacgggtaccgaaagggtacggaaacgtacgtaaacggtaacttgggtacggtactagacctaacggcttcgttacg

SEQ ID NO: 167982 - DNA, 583 bp, Homo sapiens
  misc_feature: GYAE6OF01APJTR.36.9.A09.1.454.CMB.1.raw
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaatgattaggctggtatcagacaagaaccgaggaaacgcccctaagcctacctcactctagtgtgactacttacctacgtttaacaacgtcgggtaccctattaagacttcgagcggntagtggatcgagcacagtacttcactctacaccatcancacgcgtctcgacgtcctagtaacgtatttacgcttaacttacttactcgttactaacgtaacttaacgttaacctaactttacccgttacggttaccgttaccgggacccgtaaacgggacccgtaagggtacggtaacgttaaccgaaacgttaaccgtaggtcggtaccgtacggaccacctgttcgttacg

SEQ ID NO: 167983 - DNA, 633 bp, Homo sapiens
  misc_feature: GYAE6OF01ESG3I.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaggtgtccagtgtgacgtgcaactggtggagtcgtgggggaggcttggtccagccgtggggggtccctgagactctcctgtgcagcctctggtattcaactttggtagtctattggatggactggggtccgcagtctccgaggggagggcgtgggaggtgggtggaccaacataccgagggtacggtggtaggtaacgaaaaacgtgtggtggtactcgttaggtggaccggggccgtagttcccaccgtatcctacccgaagacgaaccaaccgtaacccgaaaaactccaacttgttactactacgacaaagttcgggaccgtccgtaggagtacgtccggaacgggacacgggtcgttagtagtagtttagttggtaggacgtagtagttagtttaacggtactaaacgttaaacggtttacgaggttacggtaacgttggttaatggtaagttggttaacg

SEQ ID NO: 167984 - DNA, 698 bp, Homo sapiens
  misc_feature: GYAE6OF01A53XZ.36.9.A09.1.454.CMB.1.raw
  modified_base (229)..(229): a, c, t, g, unknown or other
  misc_feature (229)..(229): n is a, c, g, or t
  modified_base (688)..(688): a, c, t, g, unknown or other
  misc_feature (688)..(688): n is a, c, g, or t
tcagtacgctgtctcacgaccggtgctcgatttagcgagacgcgcgaggggggagtcagacccactcaggacacagcatggacatgacgggtcccccgctcagctccgtggggctcctgctgctctggcctcccaggtgccagatgtgccataccaaatcgacccagtcctccatccctccctgtcctgcatctggtaggagacagatcatcatcacgttggccggganaagtcgagggactaattaagaaatgtaagtttaggcgtggtatcgagacaaacggaaaccgaaggggaaaccgaccccgtaacgcctacctactacgtctaagtcggtcgactactaccgttaacgtttaaccgaaacggttccggggtacccctaagttaaacgtactttacgacggtcggacgtagggtaggtaacgttcgtcgggaactacgtaacgttactttacccacttacctaccgaacctactacgacgaccgaccgccgtacgacctacgtaccgtaggtaacgtttactttacgtaacctttaactttacgtttaacgttacgtaaccttaacgtaagttaacctttaaacgtaacctttacccgtacggttaccgttaccggaacgtaaacgggaaccgtaaggtacggtaacgtaacgaaacgtacgtggtacgtcgtacacctacngttcgttacg

SEQ ID NO: 167985 - DNA, 858 bp, Homo sapiens
  misc_feature: GYAE6OF01EIPWK.36.9.A09.1.454.CMB.1.raw
tcagtacgctgtctcacgaccggtgctcgatttagcgagacgcgcagggggggagtcagacccactcaggacacagcatggacatgagggtccccgctcagctccgtggggcctcctgctgctctggcctcccaggtgccagatgtcgccatccaaatcgacccagtctccatccctcctgtctagctatctggtaggagacagagtcatcatcacgtcggccggacagtcgaggactaagtagaaatgtaagtttacggcgtaggtactacgaaggtaaccgaaacggtaaaacccggaacgggaaaccgtcccccgtaaaggtcccttaccgtacctaacgttacgttaggtcggtacgacctaacgttacccgtttaaggtttaaacccgaaaacgggttcccgggttaaccctaaaggtttaaacgtacgtttacgggaacggtaccggggtactaagggttacgggtaacgttccggtaacgggtaaccctaacggttaacgtttacctttaaccgtacccttaccctaacccgtaacctaaccgttacggaaccgtaccgtaaccggtcccttcggaacccgtacggtacccgttaaggttaaccggtttacttttacgtaacgttttaacctttaacgtttaccgttaacggttaacctaaaccgttaaagttaaaccctttaaccttaaacccggtttacccccggtttacggttaacccgggttaacccgggaacccgtaaaccgggggtaaacgttaaaccggggtaacgggtaaacgttaaacccgtaaacgggtaccgttgggacccgtaccgtacggtacccaaccggttcgttcggtttacccg

SEQ ID NO: 167986 - DNA, 586 bp, Homo sapiens
  misc_feature: GYAE6OF01BR82U.36.9.A09.1.454.CMB.1.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggnaagtcgaggcatagaaatgatttaggctggtatcagcaagaaaccgagggaaacncccctaagcctcctcatctatggtgcactccaagtttacaaacgttggggtacccaattaaagattcgagcggcgtaggtgatcgtgggactaactagtactttcacttctacaccatccagcagcctgccagtcctagtaagtacgttttgacttaacgtttaattactagttactaacgaattaactttaaactaaccgtttaccccgttacgttacggttaccggaaccgaaacgggtaacccgtaagggtacggtaacgttaacgaaacgtaacgtggtacggtactcgaccgtacctagtcgtttaccg

SEQ ID NO: 167987 - DNA, 577 bp, Homo sapiens
  misc_feature: GYAE6OF01DGZ44.36.9.A09.1.454.CMB.1.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcatagaaatgtatttaggctggtatcagacaagaaacgagggaacgccctaagcctcctcatctatggtncatctagttacaacgtcgggtaccaattagattcgagcggntagtgatcgtggacacgtagttacttacacttacctaccacctatcacgactacgaccgtagccgtacgccgttaagtaagttacttttacgaccttaacgttttattacgtacgttactaaacgtaagttacttaacgtaaccttttacccgtcggttaccgttacccggacgtaacgggtacgtacgggtacggaactacgaaacgtacgtggtacgctacgacctaactgtcgttacg

SEQ ID NO: 167988 - DNA, 619 bp, Homo sapiens
  misc_feature: GYAE6OF01CVQW9.36.9.A09.1.454.CMB.1.raw
  modified_base (309)..(309): a, c, t, g, unknown or other
  misc_feature (309)..(309): n is a, c, g, or t
  modified_base (461)..(461): a, c, t, g, unknown or other
  misc_feature (461)..(461): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtggggggaggcttggtccaggccgtgggggggtccctggagactctcctgtgcagcctctggattcaactttggtagctattggatggactgggtccgccagtcnccgaggggaggggctgggagtggggtggccaacatacgaggggaggtggtggtaacgaaaaactgtgtaggactcgtgtcgggcggggtccgattcaccatcaccagacgaacaacgaacccaaaactcaactagtactctacgactaaagngggaccggtcgtagaacgacgtaccggacggaaccgacgggtcttggttacgttaatttagttggtggacggtaggtagtaattttaaacggacttaaacggttaaaggttttcggaaggttacggtacgtttagggttattacggtagttggttacg

SEQ ID NO: 167989 - DNA, 703 bp, Homo sapiens
  misc_feature: GYAE6OF01BAIQN.36.9.A09.1.454.CMB.1.raw
  modified_base (276)..(276): a, c, t, g, unknown or other
  misc_feature (276)..(276): n is a, c, g, or t
tcagtacgctgtctcacgaccggtgctcgatttagcgagacgcgcaggggggagtcagacccactcaggacacagcatggacatgagggtccccgctcagctccgtggggctcctgctgctctggctcccaggtgccagatgtgccatccaaatgacccagtctccatcctccctgtctgcatctgtaggagacagagtcatcatcacgttcgccgggacaagtcagggcagttagaatgatttaggctggtatcagcaagaaaccgagggaaacncccgtaagctcctcatctagtggtgcactaccgtaagtttaaccgaaacgttcggggtaccctaagttaacgtacgtttacgacggtccggtacgtacggttaggtacttcggttacgggacctaacgtaacggttactttaccgtaaccttccgttacccaacccgtattaccgacgaccgtaacgtcccgtacgaccgtacgtacccgttaaggtaacgttacttttacggaaccttaactttacgtttaacgttcgttaaccgttaacgtaaacgttaactttaaacccgttaacgtttaaccccgttacggttaaccgttaccgggaaccggtaaacgggtaacccgtaaggggtaccggtaaacgtaacgtaaaacggtacgttagggacgtccgtacgacctaccgttcgtcgtttacccg

SEQ ID NO: 167990 - DNA, 557 bp, Homo sapiens
  misc_feature: GYAE6OF01B7OOX.36.9.A09.1.454.CMB.1.raw
  modified_base (272)..(272): a, c, t, g, unknown or other
  misc_feature (272)..(272): n is a, c, g, or t
  modified_base (549)..(549): a, c, t, g, unknown or other
  misc_feature (549)..(549): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaaatgacccagtctccatcctccctgtctgcatctgtaggagacagagtcatcatcacttgccggcaagtcagggcattagaaatgtattaggctggtatcagcaagaaaccgaggaaacnccctaagcctcctcatctagtgtgctatctaagtttacaaacgtcgggtaccaagttaagattacagacggctaggtgaatcgtcggacagtagtatttacactctacaccatctagcaacgcctagacgacgcgtagaacttattttcgacttaactttacttactagtacctaacaagttaacttaactaacttacccgtacgttaccgttaccggactaaccgggaacgtaaggtacggaagtacaaacgtaacgtgacgtctacgacctactntcgttacg

SEQ ID NO: 167991 - DNA, 682 bp, Homo sapiens
  misc_feature: GYAE6OF01CA4TS.36.9.A09.1.454.CMB.1.raw
  modified_base (137)..(137): a, c, t, g, unknown or other
  misc_feature (137)..(137): n is a, c, g, or t
  modified_base (671)..(671): a, c, t, g, unknown or other
  misc_feature (671)..(671): n is a, c, g, or t
tcagtacgctgtctcacgaccggtgctcgatttagcgagacgcgcagggggggagtcagacccactcaggacacagcatggacatgagggtccccgctcagctccgtggggctcctgctgctctggctcccgaggtnccgagatgtgccataccaaagtcgacccagtctccatcctcctgtctgcatctggtacggagacaggatcaatcactcacgttcggaccgggactaaggtcgaggggactaagttaaggaaatggtagtttaggccgttaggtactcgaagacgaaacggaaaccggaagggaaaccgcccctaaaggtccttacctacaacttccgtagtacggtacgactaacgtaccgtaagtttaaccgaaacggttcgggtacctaagttaacgtatacgcggacggtactaggtagtacttacgcggaactaacgagttactttaccactactaccacgtatacgaacgctacggacctgaccagtactaagtaattcgtttacacttaatttacgttactagtactaacgtaattaccgttaaactaaccttacccgtacgttaaccggtaccgaaccggtaaacgggtaacccgttaaagggtacggtaaattaccgaaacggtaccgtggtaaccggtcaccggtaccaacgttnttcggttaccg

SEQ ID NO: 167992 - DNA, 800 bp, Homo sapiens
  misc_feature: GYAE6OF01DCOSQ.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggcctcccaggtgccagatgtcgccatccaaatgacccagtctccatcctccctgtctgcatctgtaggagacagagtcatcatcacgttcggccggacaagtcgagggcaattaagaaatgaagtttaggcttaggtatcgagacaaacgaaaaccgaagggaaaccgacccctaacggcccttaccctactaacgttccgttaagttcgggtacgtacctaacgtttaccccgtaaacggttttaaaccgaaaaccggttccgggggttaaccccttaaagtttaaacggttaacgtttaccggaacgggtaccgggtacgtaaggttacgggtaacttaccggtacgggaaccctaacgtaagtttaacctttacccgtaaccttaccccttaacctaacccctaagttacccgaacggtacccgaaccgtaccctaccggaccgtaccgggtacccgtttaagggtaaacgttttacgtttttaccgtaactttaaactttttaagtttaacgtttaaacgtaacgttaaaaacgttaacttaacgaccggttacccgtaccccgtacttaccgtaaccggtttccggggacgggtaaccgggtaaccgtaagggtacgggaactaaccgtaaaccgtaaacgtacgttacgtacggtctacgacctacgtacg

SEQ ID NO: 167993 - DNA, 676 bp, Homo sapiens
  misc_feature: GYAE6OF01AZJ3F.36.9.A09.1.454.CMB.1.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
tcagtacgctgtctcacgaccggtgctcgatttagcgagacgcgcgagggggggaggtcagacccactcaggacaccagcatggacatcgagggtccccgctcagctcctggggcctcctgctgctctcggcttcccaggtgccagatgtagccataccaaatcgacccagtcctccatccctccctgtctgctatctggtaaggagaccagagtcatcatcacttggccggacaagtcgaggctagtagaaatgtagttggctaggtatacagacacggaaaccgagggtaaccnccctaagcctcctnatctagtggtcncacgtcctaagttacgaaccgtggggtaccctaagttaacgacttcgaggccggacaggttggacttcggcgacacgagtactttacacctcacctaccatcacgacacgcctaggcacgtaccgtaggtaacgttgtttacgaactttaacgtttaactttacgttacgtaccttaaacgtaacgttaactttaaccgttaaaccgtttaccccgttaccggttaacccgggttaccggtaacccggtaaacggggtaacccgtaaagggggttaccggtaaacggtaaccgaaacggtaaccgttacgggttacggaccgttaccggaaccgaccgttacgtccctttacgg

SEQ ID NO: 167994 - DNA, 815 bp, Homo sapiens
  misc_feature: GYAE6OF01BZ3X4.36.9.A09.1.454.CMB.1.raw
tcagtacgctgtctcacgaccggtgctcgatttagcgagacgcgcgagggggggagtcagacccactcaggacacagcatggacatggacgggtccccgctcagctccgtggggctcctgctgctctggcctcccaggtaccagatgtcgccataccaaatcgacccagtcctccactccctccctgtctgcatcgtaggtaggagacgagagtcatcactctacgttcggaccgggacaagtcgagggctaagttaagaaatgtaacgtttaggcgttaggtatcgagaacgaacggaaaaccggaagggaaccaccccgtaacgcctacctacgtacttacgtagtcggtacgctaacgttacccgttaaagtttaaccgtaaaccgggtcgggttaaccctaaagtttaaacgtacttacggaacggacgggtactaagggttcggtaacttcggtacggaacctaacgttaacgtttacttttaacccaccgtttaccctaaccaacccgtaacgtacgaaccgggtcctaacggtcccgtacgaacccgtacgtaccgtaggttaaacgttacgttttccgtaactttaaccttttaacgttaccgtttacgtaaacgttaacccgttaaagttaaccttttaaacccgttaaaccgttttaccccgtttaaccggtacccgggttaaccgggaaacccgggttaaacgggaaacccggttaaagggggtacgaaaaccggttaacgaaaccgggttacgtacggtacgtccgtaacggaccttaacgtacgtttcccttcggttaaccc

SEQ ID NO: 167995 - DNA, 785 bp, Homo sapiens
  misc_feature: GYAE6OF01AZE3C.36.9.A09.1.454.CMB.1.raw
  modified_base (569)..(569): a, c, t, g, unknown or other
  misc_feature (569)..(569): n is a, c, g, or t
tcagtacgctgtctcacgaccggtgctcgatttagcgagacgcgcgaggggggagtcagacccactcaggacacagcatggacatgacgggtccccgctcagctccgtggggctcctgctgctctggcctcccgaggtcgccagatgtgacatccagatcgaccctagtttccactcccgtccctgtcctgctatcgtggtaaggacgacgagtacgtaccaacctagttcctaccgttcgggacccgggacggtaacggttccggaacggggtacctaactttaaaaccgtaacttaccgttaaacgttttacggtcccgttagggttacctaccgaacggtaaccgaaaccggaaaacggtaacggggtaaactcccgtaacccgtaacgtccgttaccgtaggtaacttagttacgtacgttacgtttacgttaactttacaaccggtttaagtaaccggaaacgttccgggaaccggttcctacgtttccggtacggtcgaggtcggagtaggtagtagggtagtacgggtacttcttacgacctctaaccgtacacgtcgtaancgtaaccgtcgacgtaccggacgtaccgtaagttaacggtctttaacgggttacctaacgttttaaacctttagtttaacgtaacgttaaacgtaacggtttagaccgttaacggtcgacccctaccgttaccgttcgtaccggttacgggacggtacggtaaccggtaggtacgaaccgtactaagaaccgttcggtagtccgtaagtccaaacg

SEQ ID NO: 167996 - DNA, 529 bp, Homo sapiens
  misc_feature: GYAE6OF01ATT7R.36.9.A09.1.454.CMB.1.raw
  modified_base (372)..(372): a, c, t, g, unknown or other
  misc_feature (372)..(372): n is a, c, g, or t
  modified_base (430)..(430): a, c, t, g, unknown or other
  misc_feature (430)..(430): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatcctgtaggagacagagtcatcatcacttgccgggcaagtcagggcagttagaaatgatttaggctggtatcagcagaaaccgagggaaacgccctaagctcctcatctatggtgcatcagtttacaacgtcgggtacctattaaagattcgagcggctaggtgatctaggccactagtactttacactcncgaccatcagcaagcctagcacgcctagtacgtatttgactacttatacttgtactanaagtaacttacaacttacccgtcgtaacgttccgacgtaaggaaccgaaggtacggaacgtacgaaacgtacgtggtacgcttagaccactgtcttacg

SEQ ID NO: 167997 - DNA, 544 bp, Homo sapiens
  misc_feature: GYAE6OF01EKXGE.36.9.A09.1.454.CMB.1.raw
  modified_base (331)..(331): a, c, t, g, unknown or other
  misc_feature (331)..(331): n is a, c, g, or t
  modified_base (534)..(534): a, c, t, g, unknown or other
  misc_feature (534)..(534): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaggtgtccagtgtgacgtgcaactggtggagtcgtgggggagcttggtccaggccgtggggggtccctgagactctcctgtgtagcctctggattcacctttaacaactactggatgtcctggtccgccaggctccgagggaggggctggagtgggtgccaanagtgaagccagatggaagtcagacatactatggtgactcgtgtaggaagggtccgtattcacctagtcctcgagagacacgcaccaatcaactcactgtactctgacaatgaactacgctagagacgaccgaagacacgggcttagtttaactcgtggttgacggtagaggtagggaccttaggtttgggaagttggtttaancggttacccg

SEQ ID NO: 167998 - DNA, 681 bp, Homo sapiens
  misc_feature: GYAE6OF01A7OVX.36.9.A09.1.454.CMB.1.raw
  modified_base (215)..(215): a, c, t, g, unknown or other
  misc_feature (215)..(215): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggnaagtcaggcattagaatgatttaggctggtatcagcaagaaaccgagggaaacgcccctaagcctcctcactcgtatggtgcatcctaagtttaacaaacgttcggggtaccctaagttaagattacgaggtccggcgtaaggtggtaacgttcgttacgggacctaacgtagttactttacctaccgttacctaccaaccctaacttaccgacgtaccgacgtcccgtaggaccgacgtaccgttagtaaacgtttacgttttacgtaaccgtttaaacttttaacgtttaacgttacgttaaccttaacgtaaagttaactttaaaccttaaccgtttacccgttaccggtttaacccgttaccggaaaccggtaaacgggtaaccgtaagggtaacggtaaacgtaccgtaaaacgtaacgtacggtacggtacctagaaccctacctacgttcgtttacccg

SEQ ID NO: 167999 - DNA, 838 bp, Homo sapiens
  misc_feature: GYAE6OF01A38SA.36.9.A09.1.454.CMB.1.raw
  modified_base (176)..(176): a, c, t, g, unknown or other
  misc_feature (176)..(176): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagcgttggttttccttgttgcttattttagaaggtntccagtgtgacgtgcaacgtggtggagtcgtgggggagtcgttggccgacggtccggtggggggtccctaggacgtaccttccgtccgtggttcgacctacggtccttcggttacggtactttacgttaaaccgttttgggtaacgtaccgttaaggtttcggtaagttccggggtaacgttccggggggtaccccgccgttaacggttcccgttacccggggaaagggggtaacgggggtcccgttaggggtaacggggttcggggttaccggaacccgtaaacgtacgtaacgggaaggggtagggtttacgggggtaacggtaaaacggtaaaaaaccgttggttaggtacgggtaacccgtcggttaacgggtccgggggtaccgggacccgtttaacgttacccgaaaaccgttgttacccgtaccgaacggtaacgaaaccgtaacccgaaacccgtaaaaactccgtacttaaggtaccttaccgtaacggtaacgtaaaccggtcggtaccgacgttaggaaccgttacgaccgggtaacgaacggtacgtacgttagtacgttatttagtagtacaggtagacgttaagttaacgtacgttaacgtaaggttacgtaaggttcgtacgttagttagtacggtattcggttaag

SEQ ID NO: 168000 - DNA, 683 bp, Homo sapiens
  misc_feature: GYAE6OF01DXOX0.36.9.A09.1.454.CMB.1.raw
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (288)..(288): a, c, t, g, unknown or other
  misc_feature (288)..(288): n is a, c, g, or t
  modified_base (426)..(426): a, c, t, g, unknown or other
  misc_feature (426)..(426): n is a, c, g, or t
  modified_base (468)..(468): a, c, t, g, unknown or other
  misc_feature (468)..(468): n is a, c, g, or t
  modified_base (664)..(664): a, c, t, g, unknown or other
  misc_feature (664)..(664): n is a, c, g, or t
tcagtacgctgtctcacgaccggtgctcgatttagcgagacgcgcaggggctcagagaggagccttagccctggactccaaggcctttccacttggtgatcagcactgagcacagagactcaccatggaattgggctgagcgtcggtttcgtgtaggctatttagagtntcngtgtgagtgcagtggtggcggtgtgggggacgtcgttcggtccncggtccggtcgggggtccctggancctcctcgtgcgngacgtcctgtagtatttaccgtaagtttggtagtnttagtaggtctaggaccgttcgggtccgacgtacgtccgtacggaagggggcggtggtaggtaggtcgggaccgtaccaacgtatacgggagggtaggtggttaagaaaccgtaaaatgtggacgtacgtccgtaggnggccgggtaaccctgttacctaaccgcttacccaccggtaanaccgtaccgtaacgacccgaatacttcgacttagttactcgactacgaactacgaactagggcctgggaagaccggggactaacggacgtcggttacccttaggtacttacgttccggtgggtaccgtacgggtacggtaacccttattaggtttagggtcggttacgaacgtttaattacgtaaggttaacccgnggttagggtaacccccggg

SEQ ID NO: 168001 - DNA, 673 bp, Homo sapiens
  misc_feature: GYAE6OF01EFXFH.36.9.A09.1.454.CMB.1.raw
  modified_base (219)..(219): a, c, t, g, unknown or other
  misc_feature (219)..(219): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccataccaaatcgacccagtctccatccctccctgtctgcatctgtaggagacagatcatcatcacgttgccgggnaagtcgaggacagttaagaaatgtatttaggcttggtatcagacaacgaaaccgagggaaacgcccctaagcctcctactatctagtggtcgactactacctaagtttaaccaaacggttcggggtaaccctaagtttaaacgtacgtttacgacggtccggacgtaggtaggtacgtacgtcgggactaacgtaacgttactttacctaccgttcctacctaaccctaactacgtacgtaccaccgtaccgttcgaccgacgtacccgtaagttaaacgtttacgttttacgtaccttaaacgttttatttacgttaacgttaactaacgtaaagttactttaaccctaactttacccgttacggttaccggttaccggaccggtaacggaacgtaaggtacggtaacgtaacgaaacgtagtcgtacgtacgtacacctactcgttcttacg

SEQ ID NO: 168002 - DNA, 497 bp, Homo sapiens
  misc_feature: GYAE6OF01D2H4I.36.9.A09.1.454.CMB.1.raw
tcagtacgctgtctcacgaccggtgctcgatttagcgagacgcgcaggggggagtcagacccactcaggacacagcatggacatgagggtccccactcagttcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccaggaagcccctaagctcctcatctatggtgcatccagtttacaaactggggtcccattaagattcagcggcagtggatctggcacagatttcactctcaccatcagcagcctgcagcctgaagtattttgctaacttattactgtctacaagtattacaattaccctcgtacgttcggacctaagggaccaaggtggaagtacaaacgtactagtggctgacaccactctgttacc

SEQ ID NO: 168003 - DNA, 667 bp, Homo sapiens
  misc_feature: GYAE6OF01EQ0PK.36.9.A09.1.454.CMB.1.raw
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (527)..(527): a, c, t, g, unknown or other
  misc_feature (527)..(527): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctggagcttgggttttccttgttgcttattttagaggttgtccagtgtgacgtgcaacgtggtcggagtcgtgggggagcttggccagccgtggggggtacccctgagacctctcctgtgcagccctctggattcgtaacgtttggatcttaagttggtagtggtacctcggggtcccgaccaggttccgtccgaagggggaggggcctgggaggtgggtcgaccaanagtaccggagggnggtggtagtaacgaaaaactgtgtaggacttcgtaggtcggccgggtacgattccacctatcctaccgaagaacgaccaaacgaaccctaaaaactccaacgttgtaactacgtagaactaaagtcggtacggaccttaggaggtaacnccggaaggaccggtacgggtacgtgggttacgttaatttaaggttcggtagtacgggaagttaaacggtaagttttaaccgaaattaaacggtaaacggtttacggagtacgttaacgttaggtattacgtagtgttacg

SEQ ID NO: 168004 - DNA, 770 bp, Homo sapiens
  misc_feature: GYAE6OF01C9FJH.36.9.A09.1.454.CMB.1.raw
tcagtacgctgtctcacgaccggtgctcgatttagcgagacgcgcgaggggggagtcagacccactcaggacacagcatggacatggagggtcccccgctcagctccgtggggcctcctgctgcctctggcctcccaggtcgccagatgtcgcctataccaaatcgaccccagtcctccatcccctcctagtctagcattctaggtaaggacgactagacgtcaatctaactcacgttcggccggtactaaggtcgagggactaagttaagtaaagtgttaactttagggacgttaggtactacgaacgaacgaaacggaaaaccggaacggaacccgacccctaagcctacctactactactaggtagtcgactaacttaccgtaaagttaaccgtaaaccggttccggtaaccttaaggttaaacgttacgttaccgggaacgtcggacgtaggttaacggtacgttacggtacgtaccgaagttaacgtttactttaccgtacctaccttaacccgaccgtaacgtacgtacaccggtaccgtacccgttaacggcctaaccgggttcctaaggtttaagtacccttttacgtaactttaaacgtttacttaccgttacgttaacctacgtaaacgttaccttaaactacccggttttaaccctacggttaccggtaaacggaacccggtaaacgggtaacgaacggggtaacgaacaaccggttaaacgacggttcgtacgtcgtaacgtcctaactcttcgtaac

SEQ ID NO: 168005 - DNA, 682 bp, Homo sapiens
  misc_feature: GYAE6OF01DFA60.36.9.A09.1.454.CMB.1.raw
  modified_base (307)..(307): a, c, t, g, unknown or other
  misc_feature (307)..(307): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatcgacccagtctccatcctccctgtctgcatctgtaggagacagagtcatcatcacttcgccgggacaagtcgagggctattaagaaatgaatttggctggtatcagacaagaaaccgtaggaacgaccctaagcctcctacagtctagtcggtnacattacctagtttaacaaacggtcgggtaaccctaagttaacgtacttcgaacggcggactaaggtcggtactcgtacgggacctaacggtagttactttacccacttaccctacctaaccctaacgtaccgaacgtcccgtaacgtccgttacggacccttaacggacccgtttaaggtaaacggtttacttttccggtaaactttaacccttttaagttaccgttacggttaacctaaaccgttaaacgttacgtttaaacttaaccgtttccccgtacgttaccggttaccggaccgtaaaccgggtagtaaacggtacgtaaacggtacaaacggtaacttcggtacgtctacgtccacttagtcgtacg

SEQ ID NO: 168006 - DNA, 694 bp, Homo sapiens
  misc_feature: GYAE6OF01BAPSG.36.9.A09.1.454.CMB.1.raw
tcagtacgctgtctcacgaccggtgctcgatttagcgagacgcgcaggggggagtcagacccactcaggacacagcatggacatgagggtccccgctcagctcctgggggctcctgctgctctggctcccaggtgccagatgtgacatccagatgacccagtctccatcctccctgtctgcatctgtaggagacagagtcaccatccttcgttggccgggcgtagtggaggtacattgtactaaatttatttagcctggtatcagccgagacgaccgagggagagttacctaagctactgtatctatcgctcgccttacctagttttcgacgtacggtccgacggggttcccctagtccgttaccggtttcgtacggtcggtactaagggttcgggtaacgttcgtaggggtacgtaagggttacttttaccgaaccttccgtaccctacccgtacgtacctaacggacgtacgtacccgtggtaccgacgtaccgtacggtaacgttacgttaggttaacgtaaccgttaaactttacgttttaaacgttagttaaacgtaaaacgttaacgtaaaccgtaggtaccgtacccgttacccgtaccgttaccgttaccggtttaccgggacgggtacggggaaacccgttaacgggagtaaccgtaacttaaccgaaacgtacgtgggtaccgg

SEQ ID NO: 168007 - DNA, 787 bp, Homo sapiens
  misc_feature: GYAE6OF01CQZ2Z.36.9.A09.1.454.CMB.1.raw
tcagtacgctgtctcacgaccggtgctcgatttagcgagacgcgcgagggggggagtcagacccactcaggacacagcatggacatgacgggtccccgctcagctcctggggctcctgctgctctggcctcccaggtgccagatgtcgccataccaaatgacccagtctccatccctccctgtctgcatctggtaggagacagagtcatcatcacgttcgaccgggacaagtcgagggctaattaagaattgtaagtttaggcttaggtaactacgaacgacgaaacggtaaaaccggaacggggtaaaccgacccccttaaaggaccccttccctactaacgttaccttaaggttacgggtcgtacctaacgtttaccctaaaacggttttaaaaccgaaaaaccggtttaccgggggtaaccctaaagttttaaaccggtaatttaaccggaccgggacgggtacgtaacgggttacgggtaattcgtacgggactaactaaggttacgttacctaccttacctacctaccctaagtaccgaagaccgagtcctaagccgaacgtccgtaagaacgtttaggttttacactaaacttttattacccgtaagttaacctaacgtaaacgttactttaaactaacccgtttaacccttcgggtaaccggttaaccggaacccggtaaaacggggtaacccggtaaagggttaaacgggtaaactaaccggtaaaaccggtaacggttggtacgtacctacggacctaaacctagggtccctttaacg

SEQ ID NO: 168008 - DNA, 880 bp, Homo sapiens
  misc_feature: GYAE6OF01D7B92.36.9.A09.1.454.CMB.1.raw
tcagtacgctgtctcacgaccggtgctcgatttagcgagacgcgcagggggggagtcagacccactcaggacacagcatggacatggacgggtccccgctcagctccgtggggctcctgctgctctggcctcccgaggtcgccaggatgtgccataccaaatcgacccagtctccatcctccctgtctgcatctggtaggagacagagtcatctatcctacgttcggccgggactaaggtcgaggggtactaagttaagaaagttcggtaagttttacgggcgttaggtactacgaacgtaacgaaaccggaaaacggaacgggtaaacccgtacccccgtaaaggtccctacctaccgtacttactaaggtcgggtacaccttaacgttaacccgttaaacggtttaacccgaaaacgggttcggggttaacccctaaaggttaaacgttacgttacgacggccgggtaactacgggtaggtactcgtacgggacctaaggtacgttactttaccaccgttcctaccctacgtactacgacgacctagcccgtaggacctacgtccgttaagtaacgtttactttacgtaacctttaacgttttaacgttaccgttaacgttaaccgtaaacgtaaacgtttaaacccgtttaaccgttaaaccccgtttttaacccgggtacccggtttaaccgggggttaaccccggaaaccgggttaaaaaccgggggtaaccccggtttaaaagggggttaaaccgggtaaaaacccgttaaccgggttaaaaaaccccgggttacggttcggggttaaacccgggtaccgttaacccggtaaaccccctaacccggtttaaggtttcccccgttttaacccggg

SEQ ID NO: 168009 - DNA, 851 bp, Homo sapiens
  misc_feature: GYAE6OF01DSEDN.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatctacgttggccgggacaagtcgagggctaattagaaatgtattttaggctggtactcgagacgaacgaaaccgaacggggaaacgaccccgtaaagtccttcctacgtactcttaagtcggtagactacttaccctaagtttaaccaaaccggttcggggtaccctaagtttaacgtacttacgacggtccggtacgtaggtacggtaacgttcgtacggtactaaccgtaagttacttttacccgtaacctttccgtaaccctaacccgtaacgttacccaacggacccgtacgtaccccgttcggaacccggtaccggttaacccgttaagggttaaaccgtttaacgttttttaaccggtaaacccttttaaaacgtttttaaccgttttaccgtttaaccgtttaacccgttaaaacgttaaacggttaacctttaaacccgtttaaaacccgtttaccccccgtttaccgggttaaacccggtttaccccgggtaaacccggtaaacgggggtaaaccccggttaaaggggttaaccgggttaaaaccgttaaacccggaaaacccggttaaccggttacgggttaaccggtacccgttaccggtaacccgtaacccgttaacgtttcccgtttaacccgg

SEQ ID NO: 168010 - DNA, 712 bp, Homo sapiens
  misc_feature: GYAE6OF01BSI9P.36.9.A09.1.454.CMB.1.raw
  modified_base (190)..(190): a, c, t, g, unknown or other
  misc_feature (190)..(190): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagcttgggttttcctcgttgcttcttttaagaggtgtccagtgtcaggtncagctggtggagtcgtgggggagcgtggtccagccgtgggacggtccctgacgacctctccgtgtgcagcctcgtggacttccaccttcaactacctagtggcagtcgctacgtcgggtcccgccgaggcctccgaggcccgaggggctagggaggtggggtagcgtagtttactacgtacaagttacgtggaagttaagggaaagttaaattaaaacgtacttaagtcggacaacggtaccgttaccggtagggtaaccggggtaccgttaactttacccgaaaccctacgtacccgtaccgaagtaacgaaaccttaaaccgttacccgaaaacgtaaccctacgtttacctacggttacttaccgtaagtaaccgtaaagtaccgaaaccgtacggtacccgtaggtacgaacgtacggttacggaacggtaacccgtacggtaccgtttacggttactttaacgttacgttacggtacggaaacgtaaaggtacggtacgggttaagggttaaccggg

SEQ ID NO: 168011 - DNA, 569 bp, Homo sapiens
  misc_feature: GYAE6OF01E263R.36.9.A09.1.454.CMB.1.raw
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (395)..(395): a, c, t, g, unknown or other
  misc_feature (395)..(395): n is a, c, g, or t
  modified_base (460)..(460): a, c, t, g, unknown or other
  misc_feature (460)..(460): n is a, c, g, or t
  modified_base (500)..(500): a, c, t, g, unknown or other
  misc_feature (500)..(500): n is a, c, g, or t
  modified_base (554)..(554): a, c, t, g, unknown or other
  misc_feature (554)..(554): n is a, c, g, or t
tcagtacgctgtctcacgaccggtgctcgatttagcgagacgcgcaggggctcagagaggagccttagcccctggactccaaggccctttccacttggtgatcagcactggagcacagaggactcaccatggaattggggctgagcgtggtttcgtgtagctatttagaaggtgtcagtgtgcgtgcaactggtggagtcgtgggggagcttgggtccagcccgtgggggccctgagctcncctgagcancctnagattcacgttgtgactgtgagtggtacgnggtaccncaggtcctccgagggaagggtctggaggtggngtacccaagntacgagggtacggtggtagtaacgtaaaaatgtggtcgactcgtgagggcccgggcacgttnacccgatctacagacacaacgaccaaaaattcacttatcgtactggaacctagcggaccgtcganacgagtcgaacggcaaccgggtgtgttagtaattgtggtnacgtagaagttagtaccaacgttaacgttagtttccgagttaccgtagtatagngttaagcggtttaac

SEQ ID NO: 168012 - DNA, 549 bp, Homo sapiens
  misc_feature: GYAE6OF01B9PFC.36.9.A09.1.454.CMB.1.raw
  modified_base (218)..(218): a, c, t, g, unknown or other
  misc_feature (218)..(218): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtaccagatgtgccatccaaaatgacccagtctccatcctccctgtctgcatctgtaggagacagagtcatcatcacttgccgggnaagtcagggacattaagaaatgatttaggctggtatcagcaagaaaccagggaaacncccctaagcctcctcatctatggtncatcctagtttacaaacgtgggtaccctaagttaagattcgaggtcggacaggtggaattcgtaggcacagtactttcactctacacctatcagcagcctagcagactaggaatatttagactaactttatactgtactaactagtattaactaacttaccttacgtacgttacggacctaaagggacctaaaggtacggaaagttacgaaacgtaagttgacggactcgaccactcttctcggttacc

SEQ ID NO: 168013 - DNA, 714 bp, Homo sapiens
  misc_feature: GYAE6OF01CSIJN.36.9.A09.1.454.CMB.1.raw
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
  modified_base (544)..(544): a, c, t, g, unknown or other
  misc_feature (544)..(544): n is a, c, g, or t
  modified_base (695)..(695): a, c, t, g, unknown or other
  misc_feature (695)..(695): n is a, c, g, or t
tcagtacgctgtctcacgaccggtgctcgatttagcgagacgcgcgagggggggagtcagacccactcaggacacagcatggacatggacgggtccccgctcgagctcctggggctcctgctgctctggctcccaggtcgccagtatgtcgaccataccaaatcgacccagtcctccactcctccctgtctcgctactctgaggagacgagtcgtcattcatcacgttcggccgggactaagtccgaggtctaagttaagtaaactgttagtttacggacgttaggtacttacgaacgacgaaacgtaaaaaccggacggaaacccgaccccgttaagccctacctctaacgtcgtaacggtcggtacgaccgtaacttacccgttaaacgtttaacgaaccggttacgggtaacctaagtttaacgtgttaccgacggaccgtagaggtttcggaacttcgcgaacgtaacgttataccgtttacgaccttctacctaacgtactacgacgtaacncgtacgcgtacngtactaggttaactntttactaacgttattacttacgttaacgtactaacgtaaacttactttaacgttaacccgttaccgtttacggaccccgtttaacggaaccgtaccgaaggtaacggtaggtaacgtaaccgtaaacgtaacggtgtaacgtccgttaacnccgtatccggttcttaacg

SEQ ID NO: 168014 - DNA, 776 bp, Homo sapiens
  misc_feature: GYAE6OF01BSOMC.36.9.A09.1.454.CMB.1.raw
  modified_base (224)..(224): a, c, t, g, unknown or other
  misc_feature (224)..(224): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatcgacccagtctccatcctccctgtctgcatctggtaggacgacagagtcatcatcacgttcggccggganaacgtcgagggctaattaagaaatgagtttaggctaggtatcgagacgaaacggaaaaccgaacggggtaaaccacccccgttaaaggcccttacccgttacaacgtttcgttaagtcgggttacgacctacgttacccgttaaacgttttaaacccgaaaaccggtttcggggtaccccttaaagtttaaacggtactttaccgaggccggacgtaagggtacggtaacgttcggtacggtacaacgtaaggttacttttaccgaccttacctacctaaccgtataccgtacgaccgtaacgtcccgtagccgtacgtacccgttaagtaacgtttacggtttacgaactttaacttttattacgttacgttaactaacgttaacgttaacttaaccttaaccggtttaacccgttacgggttaaccggtttacccgggaaaccgggtaaacgggtaaacccggtaggggtaacgtaaacggtaacccgtaaaacgggtaccgttacggttacggtacctacgggtaacctaccgtacgttcgtttacccg

SEQ ID NO: 168015 - DNA, 947 bp, Homo sapiens
  misc_feature: GYAE6OF01BDADC.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaaccagtggtaagttgggctgagtcgttggttttccttgttgtcttagttttaggaagtgtacagtgtgacgtgactaacgtggtggacgtcggtggggggtagtcgtttcggtacccgacggtcccgggttacggggggtccctaggacgtaccttccgttcctggtcacgacgtccttcgtacggttaactttacgttaaacgttttggtaacgtcgttaagtttaggacgtcggtacgtccggggtacccgaccgtaacggttcccggttaccgggaagggggtaacggggttcgtagggggtaacgggtcggggttaccgaaaccgtaaaccggtaaggtaaacgggtaagggggttaaggttacgggggttaaaacggttaaaaaccggtaaaaaaacgtttggttacggtacggtaacgttcgggttaggggtaccggggacccggggtaaccgtaaccttcccgaaccgttaaccgttccggtaaccgaacgggtaaacggaaacctaaaacccggaaaccctaaaaaaccctacgtaacgttacgttaaccgtacgttaacggaaaccgtaaaacggtaccgggtaaccgggtccgttaacggtaaagtacccggtaaccggaaagggtaacccggtaaccgggtcgtttacgtttaacggttaacttttaacggttggtaaccggaggttaacggttaaaaggttaacgtttaaaccggttaaacgttaaacggttaaaacggttttaacccggtaaagggttacgttaaacgggttaagggtttaactaagggttaacggttaagtttaaaccgg

SEQ ID NO: 168016 - DNA, 761 bp, Homo sapiens
  misc_feature: GYAE6OF01BJHJE.36.9.A09.1.454.CMB.1.raw
tcagtacgctgtctcacgaccggtgctcgatttagcgagacgcgcagggctcagagaggagccttagccctggactccaaggcctttccacttggtgatcagcactgagcacagaggactcaccatggaattgggctgagctggttttccttgtgctatttagagtgtcagtgtgacgtgcaacgtggtggagtcgtgggggagtcgttggtccgaggccgttgggggtccctggacgactccgtccgtgtgcacgtcctcgtggacttcgtaacgtttggtagtctagttggtagtcggtacgtcgggtaccctccgtaggttccgtaccgggaggggtaaagggggccgttaggggagggttgggggttcgggaccctaaacgtacgtaaaccgggagggggtacgggttaggggtaacggttaaaccgaaaaaaacgttaggttaggttacggtaaccgttcgggttacggtcgggggacccgggggtacccgtaacgtttacccgaaacccgttagttccccgttaaccgaacggaaccggaaaccgtaaacccgaaacccgtaaaaaaactccgaacgttagtaacttacgaacgtaaccgaaaggttacggtaccgtccgttacggacgtaacggtccggaacggtaccgacggtacgttagttagttgttacgttgtacggacgtagacgttaagttacgttaacgtaaacgttaaggttaccggtagtacgttgtagtagtgtgttagtaacg

SEQ ID NO: 168017 - DNA, 483 bp, Homo sapiens
  misc_feature: GYAE6OF02GRVT6.36.9.A09.1.454.CMB.1.raw
  modified_base (410)..(410): a, c, t, g, unknown or other
  misc_feature (410)..(410): n is a, c, g, or t
tcagtacgctgtctcacgaccggtgctcgatttagcgagacgcgcagggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactggggtcccattaagattcagcggcagtggatctggcacagatttcactctcaccatcagcagcctgcagcctgaagattttgctaacttattactgtctanaagattacaattaccctcgtacgttcgccagggaccaaggtggaagtcaaacgactgtggctgcaccatctcg

SEQ ID NO: 168018 - DNA, 541 bp, Homo sapiens
  misc_feature: GYAE6OF02JDUGA.36.9.A09.1.454.CMB.1.raw
tcagtacgctgtctcacgaccggtgctcgatttagcgagacgcgcagggggagtcagacccactcaggacacagcatggacatgagggtcccgctcagctcctggggctcctgctgctctggctcccaggtgccagatgtgccatccaaatgacccagtctccatcctcctgtctgcatctgtaggagacagagtcatcatcacttgccggcaagtcagggcattagaaatgatttaggctggtatcagcagaaaccagggaaagcccctaagctcctcatctatggtgcatccagttacaaacgtgggtccattaagattcagcggcagtggatctggcacagatttcactctcaccatcagcagctgcagcctgaatatttgactaacttattactgttctaacgtaagtacttaacgtaatttaacccgtacgttaaccgttcgggaccctaagggtaccctaaaggtcgggtaaacgtacgtaaaaccggtaaccgtaggttaacggtcgtaacggactaacccgtatccgttacgg

SEQ ID NO: 168019 - DNA, 493 bp, Homo sapiens
  misc_feature: GYAE6OF02G4OVA.36.9.A09.1.454.CMB.1.raw
tcagtacgctgtctcacgaccggtgctcgatttagcgagacgcgcagggggagtcagacccactcaggacacagcatggacatgagggtccccgctcagctcctggggctcctgctgctctggctcccaggtaccagatgtgccatccaaatgacccagtctccatcctccctgtctgcatctgtaggagacagagtcatcatcacttgccgggcaagtcagggcattagaatgatttaggctggtatcagcagaaaccagggaaagcccctaagctcctcatctatggtgcatccagtttacaaactggggtcccattaagattcagcggcagtggatctggcacagatttcactctcaccatcagcagcctgcagcctgaagtattttgctaacttattactgttactacaagtattacaattaccctcgtacgttcggaccaagggaccaaggtggaagtacaaacgaactgtaggctgcaccatctgtc

SEQ ID NO: 168020 - DNA, 494 bp, Homo sapiens
  misc_feature: GYAE6OF02F8YQ5.36.9.A09.1.454.CMB.1.raw
tcagtacgctgtctcacgaccggtgctcgatttagcgagacgcgcagggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactgggtccattaagattcagcggcagtggatctggcacagatttcactctcaccatcagcagcctgcagcctgaagtatttgactaacttattactgtactacaagtatttaacaacttaaccctcgtaacgttccgaccaagggaccaaggtggaagtcaaacgactgtaggctgacaccatctcg

SEQ ID NO: 168021 - DNA, 488 bp, Homo sapiens
  misc_feature: GYAE6OF02FT2X6.36.9.A09.1.454.CMB.1.raw
  modified_base (485)..(485): a, c, t, g, unknown or other
  misc_feature (485)..(485): n is a, c, g, or t
tcagtacgctgtctcacgaccggtgctcgatttagcgagacgcgcagggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaaagctcctcatctatggtgcatccagtttacaaactggggtcccattaagattcagcggcagtggatctggcacagattttcactctcaccatcagcagcctgcagcctgaagattttgcaaacttattaactgtactacaagattacaattaaccctcgtacttcgccaagggaccaaggtggaagtcaaacgaactgtggctgcacatntcg

SEQ ID NO: 168022 - DNA, 514 bp, Homo sapiens
  misc_feature: GYAE6OF02JC5R6.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaagggctggagtgggtggccaacatacagggaggtggtggtaacgaaaactatgtggactctgtgcggggcattcaccatctcagagacaacgaccaaaactcactgtatctgacaaatggacgcctgagatccgaggacacggctgtgtattattgtgcgagagagtttagactacgtaagttcgagtgacgtggtatgatgtac

SEQ ID NO: 168023 - DNA, 521 bp, Homo sapiens
  misc_feature: GYAE6OF02I7A7B.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttcctgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacaggggaggtggtggtaacgaaaaactatgtggactcgtgtgcggggcattcaccatctccagagacaacgccaaaaactcaactgtatctgcaaatggacgcctgagatccgaggacacggctgtgttattattgtgcgagagtatttagaacttactaaagtttcgagtgactggtatgatgtac

SEQ ID NO: 168024 - DNA, 525 bp, Homo sapiens
  misc_feature: GYAE6OF02ILDK9.36.9.A09.1.454.CMB.1.raw
  modified_base (231)..(231): a, c, t, g, unknown or other
  misc_feature (231)..(231): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcaggcattanaatgatttaggctggtatcagcagaaacagggaacgaccctaagctcctcatctatggtgcatcctagtttacaacgtcgggtacccattaagatacagtcggcagtggatctggacanagtatttcactcnctaccatcagcagcctgcacgtcctagaagttatttacgactaactttattactgttactacgtaagtaattaccaactttaccctcgttaacgttccggacacgggtactaagggtgaacgtacgaaacgtagtggtacgtctacgaccactactgttacg

SEQ ID NO: 168025 - DNA, 511 bp, Homo sapiens
  misc_feature: GYAE6OF02IQVE0.36.9.A09.1.454.CMB.1.raw
  modified_base (339)..(339): a, c, t, g, unknown or other
  misc_feature (339)..(339): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctctcaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatcctagtttacaaacgttgggtacccaattaagattcagcggnagtggatctggcacagtatttcactctcaccatcagcagcctgcagcctagaatatttgactaactttattactgtactactaagtacttaactaacttaccctcgtacgttccggaccgtaaggaccgaagggtagaacgtacaaacgatggtcggctggactaccatccg

SEQ ID NO: 168026 - DNA, 591 bp, Homo sapiens
  misc_feature: GYAE6OF02JFIKX.36.9.A09.1.454.CMB.1.raw
  modified_base (215)..(215): a, c, t, g, unknown or other
  misc_feature (215)..(215): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
tcagtacgctgtctcacgaccggtgctcgatttagcgagacgcgcgaggggggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttgccggnaagtcagggcattagaaatgattaggctggtatcagcaagaaccgaggaacgcccctaagctcctcatctatggtgcatccagtttacaaacgtcgggtacctaattaagtattcgagcggctagtgatctggcanagtacttcactcnctacatcagcacgctgactacgcctagtaacgtattttgacttaaactttacttaacgttgtaaccttaactaagtaactttaacctaaacgtttaccccgttacgtaaccggtttaccggaccctaacggggtaacctaaacggggttacggtaaacgttaccggaaaaccgtaacgttggtacgggtcctttacgggaccctaaccttacgtttaccgttaccgg

SEQ ID NO: 168027 - DNA, 518 bp, Homo sapiens
  misc_feature: GYAE6OF02GSJT4.36.9.A09.1.454.CMB.1.raw
tcagtacgctgtctcacgaccggtgctcgatttagcgagacgcgcaggggggagtcagacccactcaggacacagcatggacatgagggtccccactcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagccctaagctcctcatctatggtgcatccagtttacaaactggggtacccattaagattacagcggcagtggatctggcacagatttcactctcaccatcagcacgcctgccagccctagaacgtattttacgctaactttacttactgtacttaacaagtacttaacaactttaccctacgtacgttcgaccaacgggaccaaggtggaacgtacgaacgtaacgtgtaggctgactaccatcgttacg

SEQ ID NO: 168028 - DNA, 506 bp, Homo sapiens
  misc_feature: GYAE6OF02HB8DR.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaacgttggggtacccattaagattcagcggcagtggatcgtggcacagtatttcactctcacatcagcagcctgcagcctagaagtatttgactaactttattactgtactactaagtattacaactttacctcgttacgttcgacctagggacctaaggtgaagtacaaacgtacgttgtacggctgacactatctacg

SEQ ID NO: 168029 - DNA, 516 bp, Homo sapiens
  misc_feature: GYAE6OF02G2HC9.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaacgtggggtacccattaagattcagcggcagtggatctggcacagtatttcactctcacatcagcagcctgccagcctagaagtatttagactaacttattactgtactacaagtacttaacaactttaccgtacgtacgttcggaccaagggaccgtaaggtacggaacgtacgaaacgtaactggtacggctagacacctatctacg

SEQ ID NO: 168030 - DNA, 539 bp, Homo sapiens
  misc_feature: GYAE6OF02FQ2D6.36.9.A09.1.454.CMB.1.raw
  modified_base (216)..(216): a, c, t, g, unknown or other
  misc_feature (216)..(216): n is a, c, g, or t
tcagtacgctgtctcacgaccggtgctcgatttagcgagacgcgcaggggggagtcagacccactcaggaaacagcatggacatgagggtccccgctcagctcctggggctcctgctgctctggctcccaggtgccagatgtgccatccaaatgacccagtctccatcctccctgtctgcatctgtaggagacagagtcatcatcacttgccgggnaagtcagggcattagaatgatttaggctggtatcagcagaaaccagggaaagcccctaagctcctcatctatggtgcatccagtttacaaactggggtcccattaagattcagcggcagtggatctggcacagatttcactctcaccatcagcagcctgcacgcctagaagtatttgacaactttattactgtactacaagtacttactaacttacccgtacgttaccggttccggacctaacggggacctaaagggtacggaaaggttaccaaaacggtaacttaggtacggacttcggacctacccagttcctgttacccg

SEQ ID NO: 168031 - DNA, 492 bp, Homo sapiens
  misc_feature: GYAE6OF02GWP5N.36.9.A09.1.454.CMB.1.raw
  modified_base (269)..(269): a, c, t, g, unknown or other
  misc_feature (269)..(269): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaanccctaagctcctcatctatggtgcatccagttacaactgggtccattaagattcagcggcagtggatctggcacagtatttcactctcaccatcagcagcctgcagcctagaagtatttgactaacttattactgtactacaagtattaacaattaccctgttacgtcggaccagggaccaagggtgaagtaccgaaacgtactggtcgctgacacatcttcg

SEQ ID NO: 168032 - DNA, 551 bp, Homo sapiens
  misc_feature: GYAE6OF02HS8AR.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcaggcattagaaatgatttaggctggtatcagcagaaaccagggaaagccctaagcctcctcatctatggtgcatccagtttacaaactggggtccaattaagattcagcggcagtggatctgcacagtatttcactctcaccatcagcagcctgcagtcctagtaagtattttgactaaactttacttactagtacttaacaaagtaattaacgtaaactttaccccgtacgttaaccggttccggtaccgaacgggtaccgtaacgggtaggaacggtaccaaaacggtaacctagggtacggtacgtagaccaacctactcttacgg

SEQ ID NO: 168033 - DNA, 544 bp, Homo sapiens
  misc_feature: GYAE6OF02GZZDB.36.9.A09.1.454.CMB.1.raw
  modified_base (348)..(348): a, c, t, g, unknown or other
  misc_feature (348)..(348): n is a, c, g, or t
  modified_base (396)..(396): a, c, t, g, unknown or other
  misc_feature (396)..(396): n is a, c, g, or t
tcagtacgctgtctcacgaccggtgctcgatttagcgagacgcgcaggggggaggtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgattaggctggtatcagcaagaaaccgagggaaacgacccctaagctcctcatctatgtgcatcagtttacaacgtcgggtccattaagatcagcgcagtggatcgtggcanagtatttcactctcacatcagcacgcctgcgagtccctagtaaacgtnttttacgacttaactttattactcgtactaactaaagtacttaactaactttacccttacgtaaccgttcggaccgtaacggaaccgtaaggtaggaaacgtaacaaaacggttaatttgggtacggctagaccaacctattcttacg

SEQ ID NO: 168034 - DNA, 547 bp, Homo sapiens
  misc_feature: GYAE6OF02HIQHN.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactggggtccattaagattcagcgcagtggatctggcacagtatttcactctcaccatcagcagctgcagcctagaagtattttgactaactttattactgttactaactaagtaacttaactaactttacccttaccgttaccggttacgaccgtaacgggtaaccgtaagggtacggtaaacggtactaaaaccgtacgttacggtacggtaccgtagacctaacctacgtcttaccg

SEQ ID NO: 168035 - DNA, 513 bp, Homo sapiens
  misc_feature: GYAE6OF02I6QXX.36.9.A09.1.454.CMB.1.raw
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (391)..(391): a, c, t, g, unknown or other
  misc_feature (391)..(391): n is a, c, g, or t
tcagtacgctgtctcacgaccggtgctcgatttagcgagacgcgcagggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccaggaaacgccctaagctcctcatctatggtgcatcctagtttacaaacgtgggtacccattaagattcagcggnagtggatcgtggcanagtatttcactctcaccatcagcagcctgcagcctagaagtnttttgacttaacttattacttgtactaacaagtattaactaacttaccctcgttaacgttcggaccctaagggacctaagggtcggaattacgaaacgtatgtaggctgaccacctatctcg

SEQ ID NO: 168036 - DNA, 526 bp, Homo sapiens
  misc_feature: GYAE6OF02HHJ44.36.9.A09.1.454.CMB.1.raw
  modified_base (295)..(295): a, c, t, g, unknown or other
  misc_feature (295)..(295): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagcgtgggttttcctgttgctattttagaaggtgtccagtgtgacgtgcaactggtggagtctgggggaggcttggtccagcctggggggtccctgagactctcctgtgcagcctctggattcaactttggtagctattggatggactgggtccnccagtctccgaggggaaggggctgggagtggggtggccaacagtacaggggaggtggtggtaacgaaaaactgtggtggactctgtgcggggccattcaccatctcagagacaacgaccaaaactcactgtatctgacaaagtcggacgcctgagatccggaggacacggctgtgtattattgtgcgtagagtatttagactataagtttcgagtgactggtatgatgtac

SEQ ID NO: 168037 - DNA, 525 bp, Homo sapiens
  misc_feature: GYAE6OF02FT8F0.36.9.A09.1.454.CMB.1.raw
  modified_base (363)..(363): a, c, t, g, unknown or other
  misc_feature (363)..(363): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaacttttggagctattggatggactgggtccgccagtctccgagggaggggctgggagtggggtgccaacatacgagggaggtggtggtaacgaaaactntgtggactcgtgtgcggggccattcaccatctccagagacaacgaccaaaactcactgtatctgacaaatggacgcctgagactccgaggacacggctgtgtattagttgtgcgagagtatttagactaacaagtttcgagtacgacgtggtatgtatgtac

SEQ ID NO: 168038 - DNA, 531 bp, Homo sapiens
  misc_feature: GYAE6OF02HJSJH.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagacagaaaccagggaaacgccctaagctcctcatctatggtgcatcctagtttacaaacgtcgggtaccattaagattcagacggcagtggatcgtggcacagtactttcactctacacctatcagcagcctgcacgccttagaagtattttcgactaactttattactgtactacaagtacttaactaacttaccctagttaccgttccgtaccgtaagggacctaagggtggaacgtacgaaacgtaacgtgtggactcgccacctagttcgtacg

SEQ ID NO: 168039 - DNA, 570 bp, Homo sapiens
  misc_feature: GYAE6OF02I7SYI.36.9.A09.1.454.CMB.1.raw
  modified_base (432)..(432): a, c, t, g, unknown or other
  misc_feature (432)..(432): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcaagaaacagggaaacgccctaagcctcctcatctatggtgcatcctaagtttaacaaacgtggggtaccctaagttaaagtacttacaggccggacgtaggtggaattcgtagggaccacgtaaggtacttttaccactcctaccaccatcagcacgcctgccacgcgtagtaagtntttacgactaacttattactgtactacgaagtacttaactaacttaccctacgtacgttccgaccgtaagggaccgtaagggtcggaacgtacgaaacgtaacgtacggtacggtactacgacctaccgtatcttacg

SEQ ID NO: 168040 - DNA, 764 bp, Homo sapiens
  misc_feature: GYAE6OF02H30E8.36.9.A09.1.454.CMB.1.raw
  modified_base (250)..(250): a, c, t, g, unknown or other
  misc_feature (250)..(250): n is a, c, g, or t
tcagtacgctgtctcacgaccggtgctcgatttagcgagacgcgcagggggaggtcagacccactcaggacacagcatggacatgagggtcccgctcagctcctggggctcctgctgctctggctcccaggtgccagatgtgccatccaaatgacccagtctccatcctccctgtctgcatctgtaggagacagagtcatcatcacttgccgggcaagtcagggcattagaatgattagctggtatcagnagaaaccagggaaagaccctaagctacctcatactatggtgcattacctaagtttacctaaacgtcggggtaccctaagttaaagacttacaagcgggacctaaggtggattaccgttggccgaacgtacgtaattttcctaacctttccgaccctaaccgaacttaccgaacgtaccgtaacggcccgttcggaccgtaaccgccccgtttaacggtaaaacgggttaatttttttacgggtaacccttaaacgtttttaactttttaacccgttaacgggtttaacccttaaaccctaaaaggttaaacttttaaaccggttaaaaccttttaacccccggttaaaccgtttacccgggtttttaacccgggacccggtaaaccgggggtaaccccggttaaacggggtaccgggttaaaacggtttaaccggaaaaaccgttaaacccggttagggtttaccgggttaccaccgggttaaccctaacccctaacgttaccgttttaccggg

SEQ ID NO: 168041 - DNA, 507 bp, Homo sapiens
  misc_feature: GYAE6OF02H2CAD.36.9.A09.1.454.CMB.1.raw
  modified_base (379)..(379): a, c, t, g, unknown or other
  misc_feature (379)..(379): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (503)..(503): a, c, t, g, unknown or other
  misc_feature (503)..(503): n is a, c, g, or t
tcagtacgctgtctcacgaccggtgctcgatttagcgagacgcgcagggggagtcagacccactcaggacacagcatggacatgagggtccccgctcagctcctggggctcctgctgctctggctcccaggtgccagatgtgccatccaaatgacccagtctccatccctccctgtctgcatctgtaggagacagagtcatcatcacttgccggcaagtcagggcattagaatagatttaggctggtatcagcaagaaaccgaagggaaaagacccctaaacgctacctcatctatgtgcatccagtttaacaaactggggtacccattaaagattacacgcggacagtgatctggcacagatttcactctcacatcancacgctgcagcctagaagattttagactactttattactgtactaacaanattaacattaccctnttacgttcgctaggacgtaaggnggtaacanaaacgaactgtacgcgtgactacacgtntacg

SEQ ID NO: 168042 - DNA, 560 bp, Homo sapiens
  misc_feature: GYAE6OF02HYU7D.36.9.A09.1.454.CMB.1.raw
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggtanctattggatggactggggtccnccagtctccgaggggaggggctgggagtgggtgccaantacgaggggagtgggtaggtaacgaaaaactntgtggactcgtgtggcgggggccgatttccgacctatcctccagagacaacgaccaaaaactcaactgtatctagacaaagtcggaccggcctgacgagtaccgaggacacgggcttggtgttattattgtgcgagtagtatttaagacttaacgtaaagtttcgaagttggtactaggttatggtatgtacg

SEQ ID NO: 168043 - DNA, 514 bp, Homo sapiens
  misc_feature: GYAE6OF02GSDQA.36.9.A09.1.454.CMB.1.raw
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgcagtctccagggagggctggagtgggtgccaanatacgagggaggtggtggtacgaaaaactntgtggactctgtgcggggccgattcaccatctccagagacaacgccaaaaactcactgtatctgcaaatggacgcctgagntccgaggacacggntgtgttatattgtgcgagagagtttagacttacaagtttcgagtgacgtggtatgatgtac

SEQ ID NO: 168044 - DNA, 533 bp, Homo sapiens
  misc_feature: GYAE6OF02G7UY5.36.9.A09.1.454.CMB.1.raw
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (514)..(514): a, c, t, g, unknown or other
  misc_feature (514)..(514): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcaattagaaatgatttaggctggtatcagcagaaaccagggaaacgcccctaagcctcctcatctatggtgcatccagttacaacgtgggtacccattaagattacagcggacagtggatcgtgggacagaattcactctacacctattagcacgcctgcagcctgattgtattttcgactaanatattacngacctaagcctaaatacttaaatacggttattcgggtacgttacggaccgtaagggaccgtaggggtaggagtaacgtaccgaaacgtaacgtcggnggtaccgtcgaccactacg

SEQ ID NO: 168045 - DNA, 597 bp, Homo sapiens
  misc_feature: GYAE6OF02GN3XE.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccagatgacccagtctccatcctccctgtctgcatctgttggagacagagtcaccatcacttgccggcaagtcagagcattagcctacttttaaattggtatcagttcaaaccagggaaagcccccaggctcctcatctacggtgcgtccagtttgcagagtgggtcccaagaaggttcagtggcagtggagtcggggacagtatttcattctaccacctattaacagttactaacaaaccttagtaaacggtattttacgactaaacttactactgtacaactagtaacgttacatttactccctcggaactagtttccggaccgaacggggtaaccaaagggtacggaaaattacccgaaaacggtaccttagggtcggtaaccgttacggacctaaccctattccgttagtacctttaccgactttcccggttaccctacctaaccg

SEQ ID NO: 168046 - DNA, 492 bp, Homo sapiens
  misc_feature: GYAE6OF02HA7L4.36.9.A09.1.454.CMB.1.raw
  modified_base (489)..(489): a, c, t, g, unknown or other
  misc_feature (489)..(489): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactggggtccattaagattcagcggcagtggatctggcacagatttcactctcaccatcagcagcctgcagcctagaagtattttgctaactttattactgtactacaagtattactaactttaccctcgttacgttcgaccagggaccaggtggaagtcaaacgactgtcggctgcacatntcg

SEQ ID NO: 168047 - DNA, 628 bp, Homo sapiens
  misc_feature: GYAE6OF02GJUHV.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcaagaaaccgagggaaacgcccctaagcctcctcatctagtggtgcatcctaagtttacaacgtcgggtacctaagttaagattacagcggactaggtggatcgtggcacgtaagtacttttaccacttcctacctaacctatccacgcacgtccgtagaccacgtccttaggtaagttagttttacgacttaactttattacgttacgtacttaacgtaagttaactttaaccttaaactttaccccgttacggttaaccgttaccgggaccgtaacgggtaacccgtaagggtacgggtaaacgttaaccgtaaaaccggtaacgttaggtacggtacgtaccggaccgtaaccgtacgttacgtttaccgg

SEQ ID NO: 168048 - DNA, 530 bp, Homo sapiens
  misc_feature: GYAE6OF02G68QM.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcaagaaaccgagggaaacgcccctaagcctacctcatctatggtgcatcctagtttaacaaacgtcggggtacccattaagattacagcggcagtggatcgtggcacagtactttcactctcaccatcagcagcctgcacgcctagtaatatttgactaacttattactgtactaacaatattaactaacttaccctacgtaccgtcgaccgagggacctaagggtacggtaacgtacgaaacgtacgtaggtacggtctacgacctactatcttcg

SEQ ID NO: 168049 - DNA, 784 bp, Homo sapiens
  misc_feature: GYAE6OF02G40VC.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctttctgcatctgtaggagacagagtcatcatcacttgccgggacaagtcagggcattagaatgtatttaggctggtatcagacaagaaaccgaagggaaacgcccctaagcctcctacatctagtggtcgctactactacgtttaacaacggttcggggtaccctaattaacgtacttacgacggtcggacgtagggttaggacgttacgtagggtacctaacgtaacgttacttttaccaaccgtttcctacccgtaaccctacttaccgacggtaccgtacgtacccgtacgaccgtacggtacccgttaaaggtaacggtttaactttttacggaaacctttaaacgttttaaccttttaacgtttaccggttaacctttaaacggaaacgtttaaacttttaaacccgttaaacccttttaccccgttacggggtttaaacccgttacccgggaacccgggttaaaccgggtaacccggtaaaagggggtttaccgggtaaaacgttaacccgggtaaaaaccggtaacccggtttacgggttaccgggttacccgttaccgggtaaccctaacccgttacgtttacccgttaccgtttaaccccg

SEQ ID NO: 168050 - DNA, 509 bp, Homo sapiens
  misc_feature: GYAE6OF02G026G.36.9.A09.1.454.CMB.1.raw
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
  modified_base (433)..(433): a, c, t, g, unknown or other
  misc_feature (433)..(433): n is a, c, g, or t
  modified_base (461)..(461): a, c, t, g, unknown or other
  misc_feature (461)..(461): n is a, c, g, or t
  modified_base (481)..(481): a, c, t, g, unknown or other
  misc_feature (481)..(481): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggtttcctgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaanatacagggagtggtggtacgaaaaactntgtggactctgtgcggggcattcaccatctcagagacaacgacaaaactcactgtatctgacaatggacgctganatccgaggacacggctgtgtattattgngcgagagtatttagacttanaagtttcgagtgacgtggtatgatgtac

SEQ ID NO: 168051 - DNA, 567 bp, Homo sapiens
  misc_feature: GYAE6OF02JFINR.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggcaagtcagggcattagaaatgatttaggctggtatcagcaagaaaccagggaaacgccctaagctcctcatctatggtgcatccagtttacaaacgtgggtaccattaagattcagtcgcagtggatcgtgcacagtattcactctcacatcagcagcctgcacgtcctagaacttattttgaccttaaacgttacttactagtacctaactaagtactttaacgtaactttacccgttacgttaccgttaccggtaccaacgggtacctaagggttacggtaaacgttaaccgaaaccggtaacgttggtaaccggtcgttacgacccgtaaccctagttacccgtttacgg

SEQ ID NO: 168052 - DNA, 545 bp, Homo sapiens
  misc_feature: GYAE6OF02G24IT.36.9.A09.1.454.CMB.1.raw
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (423)..(423): a, c, t, g, unknown or other
  misc_feature (423)..(423): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtaccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcattctatggtgcatccagtttacaaacgtggggtcccaattaagtattcagcggcagtggatntgcanagtacttcactctcaccatcancagcctgcacgcctagaagtattttgactaactttattactgttacctanaacgtattaactaacttacccgttccgttaaccgttccggtaccgaacgggaccgtaagggtacggtaaacgtaacgaaacggtaaccttagtaggtactggaccacctacttactgttacc

SEQ ID NO: 168053 - DNA, 116 bp, Homo sapiens
  misc_feature: GYAE6OF02IRQ23.36.9.A09.1.454.CMB.1.raw
  modified_base (110)..(116): a, c, t, g, unknown or other
  misc_feature (110)..(116): n is a, c, g, or t
tcagtacgctgtctcacgaccggtgctcgatttagcgagacgcgcaggggggagtcagacccactcaggacacagcatggacatgagggtccccactcagctcctggggnnnnnnn

SEQ ID NO: 168054 - DNA, 667 bp, Homo sapiens
  misc_feature: GYAE6OF02FVO0N.36.9.A09.1.454.CMB.1.raw
  modified_base (193)..(193): a, c, t, g, unknown or other
  misc_feature (193)..(193): n is a, c, g, or t
  modified_base (275)..(275): a, c, t, g, unknown or other
  misc_feature (275)..(275): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtaccagatgtgccatccaaatcgacccagtctccatcctcctgtctgcatctggtagganacgagagtcatcatccacttggccgggcaagtcgagggcattagaatgatttaggctggtatcagcaagaaacgagggaacncccaagcctcctcatctatggtgcactcgtaattacgaaacgtcggggtacctattaacgattacgagtacggctaggtggactcgtaggacaagacggtattttaccgaacttccgtacctaaccacgttacaggtaccgacgtacctgaccgtacgaccttaaggaacgtttagttttacgacctaaactttttaactacttacggttacctaaagaacttaacttaaaccttaaccgtttaacccgttacggtaaccggtttcggaacccgaaagggtacccggtaaagggttaacggtaaacggtaaccgtaaaaccgggttacttaacggggttaccggtaccgttaaggaccccggtaacctaacgttacccgtttagtttacccg

SEQ ID NO: 168055 - DNA, 565 bp, Homo sapiens
  misc_feature: GYAE6OF02GKCEM.36.9.A09.1.454.CMB.1.raw
  modified_base (216)..(216): a, c, t, g, unknown or other
  misc_feature (216)..(216): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggnaagtcagggcattagaaatgatttaggctggtatcagcaagaaaccagggaaancccctaagctcctnatctatggtncatcctaagtttaacaacgtgggtaccagttaanattcgagcgganagtggatcgtggacacgagtactttcactctacaccgatcgagcagcctgccgagcctagaacgttattttcgactaactttattaccgtagttacctaacgtaataactttaactaacgttaccctacggttaccgttaccgggacctaagggtaccaagggttaacggaaccgtacgaaacggtaccgttagtcggtacgtacgaccacgttagtcgttacgg

SEQ ID NO: 168056 - DNA, 644 bp, Homo sapiens
  misc_feature: GYAE6OF02JAX2B.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttgccggcaagtcagggcattagaatgatttaggctggtatcagcaagaaaccgaggaaacgcccctaaaggcctacctcatacctagtggttcgctataccgtagtttaactaaacgtcggggtaccaattaacggtattcgagcggactagtaggatctaggcaacagtatttcactacctcaactactacagtccaagtccgttacgactaacggccctaagtaacgttactttcggaacttaacgtttattaacgttacgttaactaaaaggtttaacttaaacgtaacgttaacgtccttaaccggtccttaccgtacgttttaccgggaccgggttaacgggtaacccggttaaagggttacggtaacgttaacgttaaccgtaaaccggttaaactcggttacggtaccgttaccggtaaccttaacccgg

SEQ ID NO: 168057 - DNA, 690 bp, Homo sapiens
  misc_feature: GYAE6OF02JAGT4.36.9.A09.1.454.CMB.1.raw
  modified_base (455)..(455): a, c, t, g, unknown or other
  misc_feature (455)..(455): n is a, c, g, or t
  modified_base (678)..(678): a, c, t, g, unknown or other
  misc_feature (678)..(678): n is a, c, g, or t
tcagtacgctgtctcacgaccggtgctcgattttagcgagacgcgcgacggggctcagagaggagccttagccctggactccaaggcctttccacttggtgatcagcactgagcgaccagagggactcaccgagtcggaagttggggcgtgagcttagggttttcctgtgctatttagagtgtccagtgtgtacgtgcaactggtgagtcgtggggagcgttggtccagccgtaggggggtccctggtagactactccgtaggtcgcacggcctcgtcggacgttctaacgttttggtacgtcgttaagttgggatgggacgttgggtcccgacccgtaggtccgtacggtaacggggaacggggtactagggtaggttgggtcggaccgaacgactacggaggggtaggtggtacggtaaaccgaaaacgtgtcggtacggtacgtcgtacggnggtaccggggcctacgttccgacctacgtcctaccgacgtaacgaccgaacgtaacccaaaactcgtaccgtagtaccgtcttaggaccgtaacgtcgggaccggtcgtacggaggacgtaccggaacggtaccgaccggttcgtagttacgttaagttacgttagacggcgagtaggtagtttaacgacttaacgtaacggttcgaggttcgacgtggttancgtagtcgtacg

SEQ ID NO: 168058 - DNA, 717 bp, Homo sapiens
  misc_feature: GYAE6OF02HKJGD.36.9.A09.1.454.CMB.1.raw
  modified_base (219)..(219): a, c, t, g, unknown or other
  misc_feature (219)..(219): n is a, c, g, or t
  modified_base (693)..(693): a, c, t, g, unknown or other
  misc_feature (693)..(693): n is a, c, g, or t
tcagtacgctgtctcacgaccggtgctcgatttagcgagacgcgcagggggggagtcagacccactcaggacacagcatggacatgacgggtccccgctcagctcctggggctcctgctgctctggctccaggtgccagatgtgccatccaaatgacccagtctccatcctccctgtctgctatctgtaggagacagagtcatcatcacttcggccggnaagtcgaggctagttaagaatgtaatttaggctaggtatcagacgtaacgaaacgtaagggaaacgacccctaagccttaccgtacacttaccgttaagtcgggtacgctaacgttaccgttaagttttaaccgaaaccggttcggggtaacccttaaagttaaacgtacgttacgaacgggtaccggtacgtaaggtggtacgttacggtacggactaacgtaggttaacttttccgaactttacctaccgtaaccctataaccgacgaccgtacgtacccgtagaccgtacgtaccgttaaggtaacgtttacttttacgaactttaaaccgttttacttaccgttacgttacctaaacgtaacttaaccgtttaaaccttaacctttaacccgtagttaacccggttaccgggtacgaaccggggtacgaagggtaacggaacgtaacgaaaccgtagttcgtacggtacnccgtaacctacctcgttactacgg

SEQ ID NO: 168059 - DNA, 726 bp, Homo sapiens
  misc_feature: GYAE6OF02IJYU8.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtaccagatgtgccatccaaatgacccagtctccatcctccctgtctgcatctgtaggagacagagtcatcatcacttgccgggcgagtcaggacattgaacaactattaaattgtatcagcagagcagggatcggaccctaagctcctgtactacgtacgatgtcttacctaatttagaaaacgtacggggtacccaatccgtaaacggtttcaaggtttgaccgtaaagtaccgtagttcgtacggggtaacttaagggttaactttttacccgtttttacaacggtcctaaacgttccctaaacccgtaccgtaccccttaggtacccttaagggttaccgtaaggtaaaaggtaactttaaagtttaccggaacctaaaactaacttttaacttttccgttaaggttaccctaaacgtttaggttttaccgtacgtttagtaaccttcccgtttacccccgtaccggtaacccggtttcggaacccgtaaggggtaacccaaaggggttaacgtaaaacgttacgaaaacccggtaaccgttaggtacgggtacgttccgaacccgtacccgttagttacccgttaccgg

SEQ ID NO: 168060 - DNA, 898 bp, Homo sapiens
  misc_feature: GYAE6OF02FV1X4.36.9.A09.1.454.CMB.1.raw
  modified_base (196)..(196): a, c, t, g, unknown or other
  misc_feature (196)..(196): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtaccagatgtgccatccaaatgacccagtctccatcctccctgtctgcatctgtaggagacagngtcatcatcacttggccgggcaagtcgagggactagttagaatgatttaggctaggtatctagcaagaaaccgagggaaacaccccgtaagcctcctacacttcctagtggtgtactacgttaccgtaacgttttaaccgaaaccggttcggggtaaccctaagtttaaacgtagtttacgaggtacggacgtaaggttacggtaacttcggtacgggacctaccgttaaggttactttaccgtaaccgttacctacccgtaaccctaacgttaccggaacgtaccgtaacgtcccgtttacggacccgtaaccggtacccgttaagggttaaacgttttaaccgtttttacggtaaacccttttaaaacccgtttttaacgtttttaaccggttaacgtttaacccgtttaaacgttaaaaccggtttaaaccgttttaaaacccgttaaacccgtttttaacccccgggtttaacccggttttaaacccggggttttaacccggggtaaaccccggggttaaacgggggttaaccccgtaaaacgggggggtttaaccggggtaaaaacccggttaacccgggttaaaaaccgggttaaacccgggtttacggggtttaaccggggtaacccggtttaccggtaacccccgttaaacccggttaccggttttaccccgtttccgggtttttaaacccccg

SEQ ID NO: 168061 - DNA, 771 bp, Homo sapiens
  misc_feature: GYAE6OF02IXP04.36.9.A09.1.454.CMB.1.raw
  modified_base (198)..(198): a, c, t, g, unknown or other
  misc_feature (198)..(198): n is a, c, g, or t
tcagtacgctgtctcacgaccggtgctcgatttagcgagacgcgcgaggggggagtcagacccactcaggacacagcatggacatgagggtccccgctcagctcctggggctcctgctgctctggctcccaggtgccagatgtgccataccaaatcgacccagtcctccactcctccctgtcctgcatcgtgtagganacagagtcatcatcacgttcggccggactaagtcgagggactagttaaggtaattgtaagtttacggcgttaggtactacgaagacgaaacgaaaaccggtaacgggaaaacgtacccctaaagtcccgtacctacgtagtccgttaatcggttcgactaccttaaccgttaacgtttaaaccaacgggttacggttaaccctaaagtttaaacggtacttaccggaacggcggtactagggtcgtaacgtcggtcgacaacgttaagttactttaccaacgtttacctacctaaacgtaccttacggaacgtacccgtaaccgtaccgttaccgccggtaaccgtaccgttaacggttaaagtttacgttttaccgaacttttaaactttaacgtttaccgttaacgttaacctaaacgttaaacgttaaccttaaaccttaaccgtttaacccgtaccgggtttaaaccgtccggtaaacgaacgggtacgtaaggggttaactaaaccggttaacgaaccgttacgtagtaccggtacttaccggaacctaactacccgttattacccgg

SEQ ID NO: 168062 - DNA, 540 bp, Homo sapiens
  misc_feature: GYAE6OF02FLTN3.36.9.A09.1.454.CMB.1.raw
  modified_base (336)..(336): a, c, t, g, unknown or other
  misc_feature (336)..(336): n is a, c, g, or t
  modified_base (366)..(366): a, c, t, g, unknown or other
  misc_feature (366)..(366): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggattcaactttggtagctattggatggactgggtccgccagtctccgagggaagggctggagtggggtggccaacntacgaggggaggtggtggtaacgaaaactntgtaggactcgtgtgcggggccgattcacatctccagagacaacgaccaaaactcatgtatctgacaagtggacgcctagagactccgaggacgacggctagtagtattacgttgtgcgagagtagtttaacgacttaacgtaaagtttcgagtgacgtggtatgtagtagtac

SEQ ID NO: 168063 - DNA, 644 bp, Homo sapiens
  misc_feature: GYAE6OF02HXRON.36.9.A09.1.454.CMB.1.raw
  modified_base (435)..(435): a, c, t, g, unknown or other
  misc_feature (435)..(435): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtcgccatccaaatgacccagtctccatcctccctgtctgcatctgtaggagacagagtcatcatcacgttgccggacaagtcgagggcattaagaatgtagtttaggctggtactcgagacaagaacccgaagggaaacgcccctaagctacctacattctagtggtcactactccgtaagtttaacaaacggttcgggtacccaagtttaagacgtttacacggacggtctaaggtcggtaactcgtggacacgtagtacttttccactctaccactatcgagcgacgcctancgacgtcctagtaaacgttcttttacgacttaactttactacgttacgtactaacgtaacgtacttaaccgttaacgtttaacccgtacgtttaacccgggtcgtaacccgaacgggtacccggtaaagggtacggtaaacccgtaacgtaaaacccggtaacgttggttacggtaccaccggtacccgtaacctagttaccttacccg

SEQ ID NO: 168064 - DNA, 749 bp, Homo sapiens
  misc_feature: GYAE6OF02F10KP.36.9.A09.1.454.CMB.1.raw
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
tcagtacgctgtctcacgaccggtgctcgatttagcgagacgcgcaggggggagtcagacccactcaggacacagcatggacattaggtcccgcctcagctcctgggcgtcctgctgctctggcgttcccaggtgccaggtatgttgccattaccaaatgacccagtctccatcctccctgtctgcatcgtgtagagacagagtcgatcatcacttgccgggcaagtcagggcattagaaatgtatttaggntcggtatcagacagaaaccgagggaacgaccccgtaanccgtacctcgattacgtaagtggtacgactacgtcctaagttttacgtaaacgttgggggtaccctaagttaacgtactttaccgagaccggtacgtaagggtcggtaactcgtaggtaccaacgtaggttaacgttttaccacgttacctacccaacctcttacacgtacgtaccgacccgttacgacgaaccgtacccgtaagtaacgttaactttttcgggaccttaaaacttttacttaccgttaacggtttactaaaccgtaaagttaaaccgtttaaccttaaaccctttacccggtttaaccgttaaacccggtttcccgggaaaccggttaacgggtaacccgggtaaagggtacgggttaaacgtaaaccggtaaaaccggtaacccgtttaggtacggttacccgttacgtaaccggtaaccctacgttaccggttacgtttaccccgg

SEQ ID NO: 168065 - DNA, 827 bp, Homo sapiens
  misc_feature: GYAE6OF02F18NK.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaacgtggtggaggtcgtggggggaggcgtttggtcccgagggcccgggggggtccctggacgactctcctgtgtacgcctctggattccgacctttaacaactacgtggatcgtccgtgggtccgccgacggcctaccggaggggaagggtacgtgggacggttacgggtctacgaacgtcctaattacgggtcggtaccgacggtacttacgactaactacttaccgttcgactaacgaccttccggtagggtaacggggtcccggtttaccaccgtacgttaccggtccgaaggtaacgtaacctaaacgttacccgaaacgtaaaccaaaccgtaaacgaaacggttaactaccgtacgtaacctaaaacgttacggaaacccgaacggtacccgttagggaacggtaaccgggaccgggtaaccgggaaccgtacccggggtacccgtttaccgttaacggttttccgttacggtaggtaccgtaaacggttaccccgtttttaaggtttaccgggtttaaaccgggtttaacggttacgggttaaacgggtttaacgggggtaaaccgggggggttaccggtaaccggtttaccgggggtacgggggtaaccccgggtaaggggttaacccgg

SEQ ID NO: 168066 - DNA, 731 bp, Homo sapiens
  misc_feature: GYAE6OF02I6VC2.36.9.A09.1.454.CMB.1.raw
  modified_base (323)..(323): a, c, t, g, unknown or other
  misc_feature (323)..(323): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttcctgttgccattttaaaggtgtccagtgtgaaatgcagctggtggaggtccgggggaggtcttgggttcagggcccgggggggtccctggacgactctaccgtgtcgcgacgcctctcggtacttcccccttgacgtacgaccttaccgtggagtcgcacgttcgggtcccnccgaacgccgttacccggagggggaagggggtccgttgggtaggtcggggtctacgacgttagttagtaggtgagtggggtattaacactaaactagtggttaggacgttcggtagggaacggtcctacgttccaccgtacttccgtccgaacgtaacgaacccgtaaaccggacctaaaacggaaccaaccggtctacggtacttacctaggaacctaaataggaaaccctaggttcctaaggacggacgccggaacgggaacgacggtacgttagttacggtttattaaggttgtacgtacgttaaccgggtttcggttaaactttaacggggttacggaacccgtacggtaccggtaaccggtaagggcccggggtaacccggtaccgggtacccggttaccggg

SEQ ID NO: 168067 - DNA, 542 bp, Homo sapiens
  misc_feature: GYAE6OF02G8AP4.36.9.A09.1.454.CMB.1.raw
  modified_base (444)..(444): a, c, t, g, unknown or other
  misc_feature (444)..(444): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttggccggcaagtcagggcattagaaatgtattaggctggtatcagcagaaaccagggaaacgcccctaagcctacctcatctagtggtgctatcctaagtttaccaaacgttcggggtacccaattaacgtacttacgtagcggactaggtggtattcgtaggcaacgagttacgtttcaccgttctacacctatcagcacgcctgcacgccttagacgttatttgacttaacttnttactgtactaagaactattactaacttacctacgtacgttacgacgaggaccgaaggtcgaatacgaaacgtacgtaggcgtcncgacactntctcg

SEQ ID NO: 168068 - DNA, 851 bp, Homo sapiens
  misc_feature: GYAE6OF02HJK3Y.36.9.A09.1.454.CMB.1.raw
  modified_base (137)..(137): a, c, t, g, unknown or other
  misc_feature (137)..(137): n is a, c, g, or t
  modified_base (200)..(200): a, c, t, g, unknown or other
  misc_feature (200)..(200): n is a, c, g, or t
  modified_base (401)..(401): a, c, t, g, unknown or other
  misc_feature (401)..(401): n is a, c, g, or t
tcagtacgctgtctcacgaccggtgctcgatttagcgagacgcgcaggggggtagtcagacccactcgaggacacagcatggacatgagggtccccgctcagctcctgggctcctgctgctctggctccaggtgccngatgtgccataccaaatcgaccctagtcctccatccgtccctgtctgactatctaggtagganacgagacgttcaacttcattccgaagttcgggcccgggtactaaaggtccgaacggggtctaacgtttaagaaacgttagttaagttttacggccgttagggttaattaccgagacgtaaacggaaaaccggaacggggaaaccgtaccccgtaaacggtcccttaccgtaacgtacgttaccgttaacggtcgggttacnccgtaacttaccgtaacgtttaaccaacggttccggggtaaccctaggtttaaacgtaccgttacgaacgggttccgacgtaggtcgtaacgttccgtaaggcctacgagttaacgtttccaacttacctttacacccttaacgtacctaacgggttcccaaacggtccgttaccggaccgtacgtacccgtttaagggaaaaccttttccggttttaagaaccgttttaaacttaacgttttactaacctttaaacgtaaccgttaaaaggtaacctttaaccggttaaacttttacccgtaaaccggttaccgtttaccgggtaacccgtaacggggttaccgttaaccggggttaagggtaaaccctttaaaggggtaaaccctaacggggttttacgtacgggtaacccttagggtaacccctaaccggtacttaccggttaaccg

SEQ ID NO: 168069 - DNA, 720 bp, Homo sapiens
  misc_feature: GYAE6OF02JH67O.36.9.A09.1.454.CMB.1.raw
  modified_base (219)..(219): a, c, t, g, unknown or other
  misc_feature (219)..(219): n is a, c, g, or t
tcagtacgctgtctcacgaccggtgctcgatttagcgagacgcgcagggggagtcagacccactcaggacacagcatggacatgagggtcccgctcagctcctggggctcctgctgctctggctcccaggtaccagatgtgccatccaaatgacccagtctccactcctccctgtctgcatctggtaggagacagagtcatcagtcacgtcggcccggnaagtcgaggctattagaatgattaggctggtatacagacaacggtaaccgacgggaacgcccctaaggctccgtaccattcgtatcggtacgcctacgtacccttacggttaacctaaccgggtacgggtacccgtaagttaaacggtacttccggtacgggacggtccgtaacggttgggtaacggttacctacgggtaacgtactaacggttactttaccctcccgttacctaccaacccgttactacgtaccgtaccgtacggtacctacgtaccgtaccgtacggttaacggttaaagttacgtttacgttaccgttaaacctttctttaaccgttacgtttaaccgtaacctaacgtttaaacgttaaccttaacggtttacccgtaccgggttaccgttccgggtaccggaaccgggtaaccgggtaacggtacgggtaaccgtacgtaaacggtaccgtaggttcgcgtactaccgacctcggtaccttggtac

SEQ ID NO: 168070 - DNA, 630 bp, Homo sapiens
  misc_feature: GYAE6OF02FK3NL.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaacgccctaagctcctcatctatggtgcatcctagttaacaaacgtcggggtacccaagttaacgtattacgagcggacaggtagatcgtggcacgagtacttcactcctacactactcagtcacgtcctcgcacgacctgtaaacgttattttcggactttaaaccttacgtttaccttacggttacctaaacgtaaacgttactttaaaccgtaactttaaaccccttaccgtttaaccggttaccgggtaaaccgtaaccggggaaccgtaaacggggttaacggaaccggttaaaactaaaaccggtaaaccgtttacggtagggtaccgttacggactaacccgtacttccgtttaccg

SEQ ID NO: 168071 - DNA, 633 bp, Homo sapiens
  misc_feature: GYAE6OF02H59BK.36.9.A09.1.454.CMB.1.raw
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
tcagtacgctgtctcacgaccggtgctcgatttagcgagacgcgcagggggggagtcagacccactcaggacacagcatggacatgagggtccccgctcagctcctgggggctcctgctgctctggctcccaggtgccagatgtgccatccaaatcgacccagtctccatcctccctgtctgcatctgtaggagacagagtcatccatcacttcgaccgggacaagtcagggctaattagaaatgatttaggctggtatcaganagaaacaggaaagcccaagctcctnatctagngtgactataccgtagttacaaaacgttcggggtacctaagtaagtactgtacgacggtctaagtcggatacgtggtacacgaagtattttccgacttactacctaactactacgaacgacgaagtcctagtcctaagggcccttaagaaaggttattttcgaacttaaacttaactttacgtagttccaaacgttaagtaacttaaactaacctttaacccgtcggttaaccgtacgggtaacccgaaggggtacccgtaaagggtcgggtaaacgaccgtaaaaccggtaacgtggttaacggtcgtaaccggttacaaacctccgttaattccgg

SEQ ID NO: 168072 - DNA, 708 bp, Homo sapiens
  misc_feature: GYAE6OF02G90MU.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtaccagatgtgccatccaaatgacccagtctccatccctccctgtctgcatctggtaggagacagagtcatcatctacgttcggccgggacaagtcgagggctagttaagaatgtattaggcgtggtatcagacaagaaaccgaagggaaccacccgtaagctcctctatactagtggtgctactaccgtagttaacgaaccggttcggggtaccctaagttaacgtacttacgacggcggtacgtaggtgtacgtcgtagacgacgtaagtactttacctacgttcctacctaacctacgtacgaacgacgtaccgtccgtacgtccgtaacgtaccgtaagttaaaggtttactttacggtaaaccctttaaacgttttaacgtttaccgttaacgttaaccgttaaaccgtaagttaaaccctttaacttaaacccgttttacccgttaaccggttacccggttaccggaaccggtaaacgggtacccggtaagggtaacggtaaacggtaaccgaaacggtcgttaacggtacggtacgtacgtaccgtaacgtacttcgtactttacccg

SEQ ID NO: 168073 - DNA, 621 bp, Homo sapiens
  misc_feature: GYAE6OF02JWUS2.36.9.A09.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
  modified_base (448)..(448): a, c, t, g, unknown or other
  misc_feature (448)..(448): n is a, c, g, or t
  modified_base (602)..(602): a, c, t, g, unknown or other
  misc_feature (602)..(602): n is a, c, g, or t
  modified_base (615)..(615): a, c, t, g, unknown or other
  misc_feature (615)..(615): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatggtnccatccaaatgacccagtcctaccatccctccctgtctgcatcgtgtagganacagagtcatcatccgtacgttcggaccgggcaaggtcgaagggctaagttaagaatggtatttaggcttggtatcngagaagaaaaccgtaggaaaccacccgtaagcctacctccgtaatacctagtcggtacncgtactacgtaacggtttacaacgttcggggtacctaattaacggtattaccgagggacgtactaaggttcgatcgtacggacaacgtagtactttcgactctacactagtcgacnctactcgtagcctacgaccgttacgtaattcctttaaggacttaacgtttacctttagtacgtacctagtaaactctttaaacctcttaccgttacgttaacggtctaaccggaggtaaccgtaggtaacggtaaccaacgtacaagtcggtcngtactacaacctnacttcg

SEQ ID NO: 168074 - DNA, 594 bp, Homo sapiens
  misc_feature: GYAE6OF02J1EL0.36.9.A09.1.454.CMB.1.raw
  modified_base (291)..(291): a, c, t, g, unknown or other
  misc_feature (291)..(291): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
tcagtacgctgtctcacgaccggtgctcgatttagcgagacgcgcagggggagtcagacccactcaggacacagcatggacatgagggtccccgctcagctccgtggggctcctgctgctctggctcccaggtaccagatgtgccatccaaatgacccagtctccatccctccctgtcctgcatctgtacggagacagagtcatcatcgacttgccgggacaagtcgagggcagttaagaatcgagttaggcttggtatcagcaagaaacgaggaacggacccaagctccnctatctaatgtgctatccgaagttacaacgtcggtaccagttanattcgancggcagtgactntaggtcacgtagtacttcgtctactaccacctattacgactcgtaccgaccgtgaccgacaccgtgaacgtttaacgtttataccgtaactttattacttacgtaactactaaagtacttaaccttaatttacccttagttaccggtaccgtaccgtaaggaccctaaggtacggtaaacgtaacgtaacggaacgttgtacggtcgtaacggtacctaccgtattacgtcgtttaaccg

SEQ ID NO: 168075 - DNA, 657 bp, Homo sapiens
  misc_feature: GYAE6OF02G07U9.36.9.A09.1.454.CMB.1.raw
  modified_base (300)..(300): a, c, t, g, unknown or other
  misc_feature (300)..(300): n is a, c, g, or t
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcgttggtccagccgtggggggtccctgagactctcctgtgcagcctcgtggattcaactttggtagctagttggatggactgggtccnccgtagtctccgagggaagggctggagtgggtgaccaacagtacgaggggacggtggtaggtaacgaaaaacgtagtggtaggactcgtgggtcggccggggccgtattccgacctatccctaccgagacgaccaacggaacccaaaacgtcaacgtagtactctcgaactaaacgtcggaccggcccgtagaacgacgtacccggaagggtacccgacgggtccgttaggttacgttaagtttacgttaggtagtaccggtaggtaagttaacgtttaaggaaccgtttaaactaaaggtttttaccggaagtttacggaaccgtttagggttaacgttaggtacgttggttaacg

SEQ ID NO: 168076 - DNA, 597 bp, Homo sapiens
  misc_feature: GYAE6OF02JGRSF.36.9.A09.1.454.CMB.1.raw
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccataccaaatgacccagtctccatcctccctgtctgcattctgtagganacgagatcatcatcacgttggccggacagtcgaggctaattaagaatgtattggctaggtancagcaagaaacgaggaaacncctagcctctnatctagtggncatccgtaagtttaaccaacggttcggtcctaagttaacgtattcgaggccggataggaggtacttcgagaccctaagagttactttaccacttacctaccaccgtactacgacacgtacgtcgtacgaccgacgtccgtaaagttaacgttagttttacgaacttaacttacgtttactacgttaactaacgtaagtaaacttaacgtacttacccggtacgttaccggtaccgaacgacgggtacgtacggtacggaacttacgaacgtacgtgtcgactacgtacgactagtcgttac

SEQ ID NO: 168077 - DNA, 558 bp, Homo sapiens
  misc_feature: GYAE6OF02HEVK9.36.9.A09.1.454.CMB.1.raw
  modified_base (379)..(379): a, c, t, g, unknown or other
  misc_feature (379)..(379): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggcaagtcagggcattagaaatgatttaggctggtatcagcagaaaccagggaaagcccctaaagcctcctcatctatggtgcatccaatttacaaacgtgggtaccctataagattcagcggcagtgatctggcacgagtctttacacttctccaccatccagcancctgacagcctgtaatatttcgactaactttattaactgttactaactaagtaatttaactaactttaccccgtagttaaccgtttacggaccgtaacgggtaaccgtaagggtccgggaaacgttaccgaaaagttaacgtcgttagggtctaacgctaacccgttatcccgttacgg

SEQ ID NO: 168078 - DNA, 591 bp, Homo sapiens
  misc_feature: GYAE6OF02GP1CV.36.9.A09.1.454.CMB.1.raw
  modified_base (270)..(270): a, c, t, g, unknown or other
  misc_feature (270)..(270): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggcaagtcgagggcattagaatgatttaggctggtatcagcagaaaccagggaaacncccctaagcctcctcatctatggtgctatccagtttaacaaacgtcggggtacctaattaagattcaggcggcagtggatcgtggcacagtactttcactctacaccatcagcagcctgcacgcctagaagttatttacgacttaaactttattacgtcgttacttaactaaagtaactttaacctaaactttacccgttaccggttaacggttcccggaccgtaacgggtaaccgtaagggttacggtaaacggtaacccgtaaaacggtaccgttggtacggtaccgtacggacctaacccgtacgttccgtttaccgg

SEQ ID NO: 168079 - DNA, 616 bp, Homo sapiens
  misc_feature: GYAE6OF02JIEM9.36.9.A09.1.454.CMB.1.raw
  modified_base (124)..(124): a, c, t, g, unknown or other
  misc_feature (124)..(124): n is a, c, g, or t
  modified_base (208)..(208): a, c, t, g, unknown or other
  misc_feature (208)..(208): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagtacgctgtctcacgaccggtgctcgatttagcgagacgcgcagggggggagtcagacccactcaggacacagcatggacagtgagggtccccgctcagctccgtggggctcctgctgctntggctcccgaggtgccaggatgtgaccataccaaatcgacccagtcctccactccctcctgtctgcattctggaggagacaggntacatcatcacgttcggccgggacaagtcgagggacagttaagaatgtagttagctaggtactcgancaagaaccgaggaacgaccctagcnctacntacngtgacncatcctaagttacaaaggtcggtaacctagtaactataccgaggagtaccgttaggacgtacgtacgtgactaagtagttacttacgaacttccacgtaacacgtacgacgtctacgcgtacgacgacgtacgtaagtagttacttactacttaacttacttacttagtaactaacgtaacgttaacttaactaaccttaccgtacgttacgtaccgtaccgtaacgtaacggtaacggtaacggtaacgtaacgtaaacgtaacgtacgtacgtacgtacgtacgtactacgtacgtacg

SEQ ID NO: 168080 - DNA, 763 bp, Homo sapiens
  misc_feature: GYAE6OF02GQZJ6.36.9.A09.1.454.CMB.1.raw
  modified_base (203)..(203): a, c, t, g, unknown or other
  misc_feature (203)..(203): n is a, c, g, or t
tcagtacgctgtctcacgaccggtgctcgatttagcgagacgcgcaggggctcagagaggagccttagccctggactccaaggcctttccacttggtgatcagcactgagcacagaggactcacatggaattggggctgagctgggttttccttgttgctattttagaaggtgtccagtgtgacgtgcaactggtggagtcgngggggaggcttggtccacggaccgtggggggtccctggagactctcctgtcgcgagtctcgtggtaattaattcgtttagtagtactatcgacctagtgtaactcgtagggtcccgaccgacggtaccgtaccggagggaacggggccgtagggtagtacggggtccttacgagaccgttaaaagttaacgttagggtaaggggtgtaacgttacctaaccgtaacgtaagtttacccgggacggtaccggttaccgggtacggggggggtaccccgttacgacccgtacgtaccgtaaccgaacggacgtaaccaaaccgttaccgaacggaacgtaccgaaccgtacgtaattacgtactacggaactaaaacgtccggaactaacgaaccggtacccgtacggtaaggtacgggtaccgaaacgggtacccgaccggtaccgttaccgttaagttacgttggttacgaccggtaaggtaaccgaaccgttacccggtaacgggttaccgaacccgtaacggttaccgtttacgggttacgttccggttttttaacgg

SEQ ID NO: 168081 - DNA, 686 bp, Homo sapiens
  misc_feature: GYAE6OF02JHF23.36.9.A09.1.454.CMB.1.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccataccaaatcgacccagtcctccatccctccctttctgcatctgtaggagacagagtcatcatcacttcggccgggacaagtcgagggactagttagaaatgtatttaggctaggtactcgagacaacggaaaccgagggaaacncccctaagcctcctanactctagtggtacactagtacctaagttaacgaaaccggttcgggtaacctaagttaacgattaccgacgggtcgacgtagggtgtacgttcgtaggaccaacgtagttacctttaccacctttccaaccaccctaatacccggaacgtccgaacggttccaggtaccctacgttacccgtaggttaaacgttcttttacgaccctttaatttactttaccgtacgttaactaactaagttaacttaaaccgttacctttaaccgttacgttaccggttaccggaacgtacggtaacgtacgggttaacgaacgttaaacgtaaccggtaacggttcgtacggtaccgtacgacctacctacggttaccgtattacccg

SEQ ID NO: 168082 - DNA, 739 bp, Homo sapiens
  misc_feature: GYAE6OF02FWRY9.36.9.A09.1.454.CMB.1.raw
  modified_base (195)..(195): a, c, t, g, unknown or other
  misc_feature (195)..(195): n is a, c, g, or t
  modified_base (479)..(479): a, c, t, g, unknown or other
  misc_feature (479)..(479): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtcgccagatgtgccatccaaatcgacccagtctccatcctccctgtctgcatcgtgtagganacgagagtcatcatccacgttcggccgggacaaggtcgacggggctaagtttaagaaattgtaagtttacgggcttagggtacttcgaacggacgaacggtaaaaacccggaaggggaaaacccgccccgttaaacggcccttacctcgtaacttccgttaagtggtcgacctacttaccgttaacgtttaaccaacggttccgggtaacctaaggtttaaacgacttacggacggtccggagtacggtacggtactcgtacggactaacgtagttactttacnccttacctaccgaactactaccgagtcccacggtccctaggaccgtaccgttggtaaacgttaagtttcgttttacgaaacctttaaacgttttcgttaactttaaggtaccttagaaaccgtttatttaaccctaacgtttaccccgttggttaaccccggttacggaaaccggtaacgggtaccgtaaaggggtaacgaacgtaaacccggtaaacttacggttcggaacggttcaaccgcctaaccgtattcgtacg

SEQ ID NO: 168083 - DNA, 787 bp, Homo sapiens
  misc_feature: GYAE6OF02IRNBQ.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatcgacccagtctccattccctccctgtcctgctatctggtaggagacagagtcatcatctacgttcggaccgggcaagtcgagggctaagttaagaaatggtaagtttacggcttaggtactcgagacgaaagaaaaccgacgggaaaccgtaccccgtaagccttacctactacttacgtagtggtacgtacctactaccgtaacggtttaaccaaacggttcggggtaccctaaagttaacgtacttaccgacggtcggacgtaagggtggtacctcgtacgggacctaacgtacggttaactttccgaacctttccgtaccctaaaccgtacgtaccgacggaccgtaaccggtccgttaaggaccctaacgggttaccttaacgggttaacgttttacgtttaacggtaaccctttaaacgttttacctttaaccggtaccgtttaaccgtttaaagtaaaccggtttaaactttaacccgttaaaccgttttaccccgggtttaacccggttacggtttacccggaaccgggtaaacggggtaacccgtaagggggtaacggtaaccgttaaacggtaaaccgtacggtttcggtacgggtcctacggacctacgttacgtcgttaccg

SEQ ID NO: 168084 - DNA, 582 bp, Homo sapiens
  misc_feature: GYAE6OF02G6M0O.36.9.A09.1.454.CMB.1.raw
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggcagtcaggcattagaaatgatttaggctggtatcagcagaaaccgagggaaacgcccctaagcctacctcatctatggtgctatcctagtttaacaacgtcggggtaccagttaacgattcagcggactaggtggatcgtcgacactagtatttcactctacacatacacgcacgcctgcacgccgttagaagttctttagactaactttacttactgttactaacgtaagtactttaacaactttacccttacggttaaccgttaccggaccgtaacgggaccggtaacgggtacggaaacgttaaccgaaaacgtaacggttacggtaggtacctacgggtaacctacccgtatttaccgttacgg

SEQ ID NO: 168085 - DNA, 614 bp, Homo sapiens
  misc_feature: GYAE6OF02FJVPM.36.9.A09.1.454.CMB.1.raw
  modified_base (192)..(192): a, c, t, g, unknown or other
  misc_feature (192)..(192): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (414)..(414): a, c, t, g, unknown or other
  misc_feature (414)..(414): n is a, c, g, or t
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatcgacccagtctccatcctcctgtctgcatctgtagganacaggatcatcatcacttgccggcagtcaggcattagaatgtattagctaggatcagcagaaccgagggaacnccctaagcctctctatcgtagtcggtnctattccagtttaccaacggttcgggtacctaagttaacgacttcgacgcggagtaggtcgtactcgtggacctacgagtactttccactacctctaccactcgaagtccgagtaccgtacncgtaccggtacttaggaacgtttagtttaccgaacttaaactttacgtttacctacgttacctaacgtaagttaacctttaacgtaaccgttacccgttcgttaccggttaccggaccgaacgggtacgtaacggtaacggaacgttaacgtaacgtaacgttcgggacgtacggaccgtactacctacgttacgtaccg

SEQ ID NO: 168086 - DNA, 932 bp, Homo sapiens
  misc_feature: GYAE6OF02HR67E.36.9.A09.1.454.CMB.1.raw
tcagtacgctgtctcacgaccggtgctcgatttagcgagacgcgcgaggggggagtcagacccactcaggacacagcatggacatgagggtccccgctcagctcctggggctcctgctgctctggcctcccaggtgccagatgtgccataccaaatcgacccagtcctcctactccctcctgtctcgctactcgtaggtaggacgacaggtacgtacataccactcctacgttcggaccgggactaaaggtccgaagggtactaaagtttaaagaaattggtaagttttaacgggacttgggttaactaccgtaagacgaaacggaaaaacccggaaggggaaaaccctacccccgttaaaaggcccttaccccttacaaccgttacgttacgttcggggtacacgttaaccgttacccgttaaaggtttaaacccgaaaccgggttcggggtaaccccttaaagttaaacgtcttaccgaggtacccgggattaacgggtaggtacttccggtaacggactaaccgttagttacgtttacccctacgttaccgttacccctaaaccgtagtaccgtaccgtaacgtaccgttacccggtcggtaaccgtaaccggttaccgttaaagggtttaacgtttaacgtttaccggaacccttttaaaacgttttttaaccgtcgtttaacccggttaaaccttaaacgttaaacggttaaccttttaaaccccgttaacccttttaaccccgggttacgttaaaccccgggggtttaaccgaacccggggttaaacggggttaaccccgtaaacggggtttaacgggtaaaccccggttaaaaaccggttaaaacgtaacccgggtttccgggttaacccgtcgggttaaccgaaccccgttaaaccggtttcgtacccttttttaacccccggg

SEQ ID NO: 168087 - DNA, 816 bp, Homo sapiens
  misc_feature: GYAE6OF02HNL8Z.36.9.A09.1.454.CMB.1.raw
tcagtacgctgtctcacgaccggtgctcgatttagcgagacgcgcgagggggggagtcagacccactcaggacacagcatggacatgagggtccccgctcagctcctggggctcctgctgctctggctcccaggtgccagatgtgccatccaaatcgacccagtcctccatccctccctgtctgcatcgtaggtaggagacagagtcatcatcacgttcgccgggacaagtcgagggctaattaagaaattgtaagtttaggctaggtatcgaagacaaacggaaaccgaaggggaaaaccgaccccgtaaagcccttaccctacctacttcttaacgtgggtacgacgtaacctaccgttaacgttttaaccgaaaccggttcggggtaacccttaaagtttaaacgtacttaccggagtaccgggtacgtaggtaggtacgttcggtacggtaccaacggtaacgtttacgttttacctacccttccttaacccgaacctacgttaccaacggtacctaaccggtcccgtacggacccgtaccggtacccgttaaaggttaacgtttactttacgtaaacttttaacgtttaactttaccgttacgttaaaccgttaacgtaaacgtttaaccttaaaccgttaaaccgttttacccggttaacccggtttaaccggttaacccgggtaacccggtaacggggtaaccggttaacggggttaaccggtaaaccgtaaaccggtaaaacgttaccggttaaggtaaccgggtacccgtaacgtaccccgtaaccgtacgtttccgtttaacccgg

SEQ ID NO: 168088 - DNA, 619 bp, Homo sapiens
  misc_feature: GYAE6OF02HL0G4.36.9.A09.1.454.CMB.1.raw
  modified_base (256)..(256): a, c, t, g, unknown or other
  misc_feature (256)..(256): n is a, c, g, or t
  modified_base (310)..(310): a, c, t, g, unknown or other
  misc_feature (310)..(310): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
  modified_base (489)..(489): a, c, t, g, unknown or other
  misc_feature (489)..(489): n is a, c, g, or t
tcagtacgctgtctcacgaccggtgctcgatttagcgagacgcgcgaggggctcagagaggagccttagccctggactccaaggcctttccacttggtgatcagcactgagcacagagactcaccatgaatgggctgagctggttttctgttgctattttagaggtgtccagtgtgacgtgcaacgtggtggagtctgggggggagtcttggtccaggccgttgggggggtccctggaacgcgtctccgtgtgacncggcctcgtggtacttctaacgttggtagcttagtggatggacgtgggtcccgnacgtctccgaggggaacggcgnggtacggngggtcggaccagactacggagggtggtcggtaggtaaacgtaaaaacnggtacgtacgaacgtcgttcgnggggaccgggtccgtattccgacacgttccacgtacgagaacgaaccaacgtaaaaccactaactacgtagtcacgtanaagtacggaggcccgtagacgtaactccggaacggacgaccgtaagtcgtattagttacgtagtgacggagagtagttaaccaaggtacctaaaggttacgtagtacgtagtacgttaggatagttgtag

SEQ ID NO: 168089 - DNA, 728 bp, Homo sapiens
  misc_feature: GYAE6OF02HNCKW.36.9.A09.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
tcagtacgctgtctcacgaccggtgctcgatttagcgagacgcgcagggggggagtcagacccactcaggacacagcatggacatgacgggtccccgctcagctccgtggggctcctgctgctctggctccgaggtgccagatgtgccatccaaagtcgacccagtcctccagtccctcctgtctgcattcgtggtagganacngagtcactcactcgtaacgttcggccgggtanaagtcgaagggtctaagttaagaaatcggtatttaagggctaggtactcgacgtcgaaacgtaaaccgagggaaacctaccctaaggccttcctaactacgtacttaggtcggtacgcgtaactaccgtaaggtttaacaaaccggttcggggtacccttaagttaaacgtacgttacgacgggtacggtcgtaacgggtgtaccgttacgtacggtacaaccggttagtaacttttccgaaccttccgtaaccgaccttacgtacgaacgtctaacgtccgtacggacgtactacggttaaggtacgttacgttttacgaacttaacgtttattacccggtaagttaaccaacgttaaacgtacgtttaaaccttaaccgtacccgttaaggttacccgtaccggtaacggacggtaaccggtaagggtaagtaaccgtaagaaaccgttcgtacgtacggactacgtacccgtaacttcgtcttaaccgg

SEQ ID NO: 168090 - DNA, 656 bp, Homo sapiens
  misc_feature: GYAE6OF02FFTOY.36.9.A09.1.454.CMB.1.raw
  modified_base (292)..(292): a, c, t, g, unknown or other
  misc_feature (292)..(292): n is a, c, g, or t
  modified_base (512)..(512): a, c, t, g, unknown or other
  misc_feature (512)..(512): n is a, c, g, or t
  modified_base (603)..(603): a, c, t, g, unknown or other
  misc_feature (603)..(603): n is a, c, g, or t
tcagtacgctgtctcacgaccggtgctcgatttagcgagacgcgcaggggcgtcagagaggagccttagccctggactccaaggcctttccacttggtgatcagcactgagcacagaggactcacatggaatgggctgagctggtttccttgtgctatttagaggtgtcctagtgtgacgtgcaacgtggtggagtcgtgggggagcgttggtccagtccggtggggggtcccctggagactctcctggtcgctacgcctcgtgacttctaccttcagtacgctatagcatntaacgtcggtccgcaggtctaccgaggggacgggtcgtggaggtgggtacctctacgtctagttagtagtaagttagtattaacagtactacgtacgacaacgtactaggagtacggaacgggacctacgtacacctagtaccctaccgaggaaaccgtaacctaacggaacctaaacggtaacctaactaccgttgaacttacgtacgaacgttaaacncgaaccacgtaccgtaaggacggtaaccgacgtaaaggaccgtaccggtacgttcgtaagttaccgttacgtgggtaacggtaccgggtanacccggttacgttaagtttacgtttaccgagtttaccggttaacttaaccccg

SEQ ID NO: 168091 - DNA, 758 bp, Homo sapiens
  misc_feature: GYAE6OF02HNFDN.36.9.A09.1.454.CMB.1.raw
  modified_base (323)..(323): a, c, t, g, unknown or other
  misc_feature (323)..(323): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccatccaaatcgacccagtcctccatccctccctgtctgcatctgtaggagacagagtcatcatctacgtcggccgggacaaggtcgaggctaagttaagaaagtgtagtttaggcgtaggtatcgagacgaacgaaaccgagggaaaccgacccgtaagcctacctcatcgtagtcggnactactacgtaagtttaaccgaacggttcgggtacctaagttaacgtacttacgacggtcggtacgtaggtacggtacgttccggtacggaacgtaaccgtacgttacttttacccgtaccttacctaccctaaccgtacgtaccgtaacgtccgtaaccgtcccttacggaccgtaacggtccgttaaaggttaacgtttaacgttttccgaaactttaaccgtttaagtttaccgttaacgttaacctaaacgtaagttaaacctttaacccgtaaccgtttaaccccgttaccggttaaccggttaacccggtaaccgggtaaaccgggtaaccggtaaacggggttaacgtaaaccggtaacgtaaaacggttaccggttacgggttaccggtaccgtaccgtaacccgtaacgttaccgttcgttaaccg

SEQ ID NO: 168092 - DNA, 792 bp, Homo sapiens
  misc_feature: GYAE6OF02HJ8LE.36.9.A09.1.454.CMB.1.raw
tcagtacgctgtctcacgaccggtgctcgatttagcgagacgcgcaggggctcagagaggagccttagccctggactccaaggcctttccacttggtgatcagcactgagcacagaggactcaccatggaattggggctgagctgggttttccttgttgcttattttagaaggtgtccagtgtgacgtgcaactgggtggagtcgtgggggagcgttcggccgagccgtcggggggtccctggacgacctccgtccttggtcgcacgcccttcgtggtattcagtcgtttgatagtattagtgacatggacctacggttcggggtccgacgaaggtccgtaccggacggggaacggggccgtaggggacgggttcggggttaccgtacggtaacgggtttaagtttacggttaggtaaacgtagggttacgggtaagggtagttaggtacttaagtacggacgtaacggtaccgttaccggggtaggtaaaccggggtccgtaacgttcccgtaaaccgtaacgttcccgtaaccgaaggtaaacgtaacctaaccgttaccgaaaacgtaaccctaaccttcgtagttaccttacgtaacggtaaacctaaagtacgaaaccgtacggtacccgttaaggaaacgtcgggtaacggtaaccgggaccggtaaccggtacccggttagtttaacccgtttaacgttaacggttcggttaaacggaacggtaaacgttaacgggtaacgggttcgggtttaacggttaccgggttacgtaaaccggttaacgg

SEQ ID NO: 168093 - DNA, 795 bp, Homo sapiens
  misc_feature: GYAE6OF02JKR90.36.9.A09.1.454.CMB.1.raw
  modified_base (195)..(195): a, c, t, g, unknown or other
  misc_feature (195)..(195): n is a, c, g, or t
tcagtacgctgtctcacgaccggtgctcgatttagcgagacgcgcaggggggagtcagacccactcaggacacagcatggacatgagggtccccgctcagctcctggggctcctgctgctctggctcccaggtgccagatgtgccataccaaatcgacccagtctccatccctccctgtctgcatctggtagganacagagtcatcatctacgtcggccggacaagtcgaggactattaagaaatgtagttaggcgtaggtatcagtacaaacggtaaacgaagggtaaaccgaccccgtaagtcccttaccctactacttaccgtaagttcgggtacaccgttaactaccgtttaacgtttaaacccgaaacgggtttaccggggtaccccttaaagttaaccgtacgttaccgacgggtaccggtacgtaggtacggtacgttccgaggtaaccctaacgtacgttacttttaccacttacctacctaaccacgttaccgaacgtaccgtaccgttaccgggtctaccggaacgttcgtaacggttaacgttacggttttacgtaaccgtttaacttaccgtttacgttaccgttacgttaaacgtagttaaacttttaaccggtttaacctttaccccggttaaccgttttaaccgggtacccggtaaacccggttaacgggtaaccgggtaaacggttaacccgggtaaaggtaaacccgttaaaaaccggtcgttaccggttaacgggtaccgttaccaccggttaacccttaacgttcctttaacccgg

SEQ ID NO: 168094 - DNA, 790 bp, Homo sapiens
  misc_feature: GYAE6OF02F9SN1.36.9.A09.1.454.CMB.1.raw
  modified_base (145)..(145): a, c, t, g, unknown or other
  misc_feature (145)..(145): n is a, c, g, or t
  modified_base (202)..(202): a, c, t, g, unknown or other
  misc_feature (202)..(202): n is a, c, g, or t
  modified_base (777)..(777): a, c, t, g, unknown or other
  misc_feature (777)..(777): n is a, c, g, or t
tcagtacgctgtctcacgaccggtgctcgatttagcgagacgcgcaggggggagtcaaggacccaactcacggacacgagcactggacatgagggtccccgctcagctccgtggggcctccgtgctgctctggctccaggtgccngatggtgccatccaaatgacccaggtctccatcctccgtgtctgcatcgtgtagganaccgaggacgttcgaatcgaattcgtaaccgttcggaccggggactaaaggttccgaagggggtcctaaaggtttaacggaaaattggtaacttttaacgggaccgttagggttaacttacgtaacggttaccgaaacggtaaaacccgaacgggggaaaacccgacccccgttaaaaagggtcctttacccgtacgtaacgttaccgttaaggtcgggtttaggacctaaccttacccgttaacggttttaaaccgaaaccggttacgggggttaacccctaagttaaacggtacgttaccgtaggaccgggtacgaggggttagaacgttccgtaggtacctaacgtacgtaaccttttaccgaaccgttacctacctaaccgtaacgttaccgaacgtaccgaacgtcctacgtacgtaaccgtaccgttaaggaagttactttacgaacgtaactttaagtaccgtagttaactaacgtaacggtaacttaccaaacgttaccctacggtaccgttacgacgaacgaccgtaaggtcgaaccgtacgaacgtacgtcggagtcacgtaccncttagacgttcgg

SEQ ID NO: 168095 - DNA, 785 bp, Homo sapiens
  misc_feature: GYAE6OF02GUFNS.36.9.A09.1.454.CMB.1.raw
tcagtacgctgtctcacgaccggtgctcgatttagcgagacgcgcagggggggagtcagacccactcaggacacagcatggacatgagggtccccgctcagctcctggggctcctgctgctctggctcccaggtgccagatgtgccatccaaatcgacccagtctccatcctccctgtctgctatcgtgtaggagacgagtacgtcaagtcctataccaacggttcggaccggggtacaaggtccgaggggacctaagttaaggaaacgttgtaaacgttttaggcgttaggttactaccgaaggtaaccaacggtaaaaccggaacggggaaacctaccccgtaacgcctacctacttacgtcttaggtcggtcgactacgtaccttacggtttaaaccgaccggttacgggtacctaagtttaacgtactacgacggacggacgtaggtacggtactcggtacgtacaacgtaggttacctttacgtaccgtaccctacgtaaccctacgtcgaacccgtcgtaacgtcccggtacgaccgttaccgggaccgtttaagtaaacgtttcttttaacggaccctttaacttttaaccggtttaacctcggtttaacaaaccgtaagttaaaccttaacgttaacccgttaacccgttacggtttaacccggtaccggtaacccgggtaacggtaacgggttaaggtaccggggtaaacttaaccggaaaccgttagggtggttaccggacgttaccggtacccaacgttcgttacccgttaccg

SEQ ID NO: 168096 - DNA, 689 bp, Homo sapiens
  misc_feature: GYAE6OF02JX8NF.36.9.A09.1.454.CMB.1.raw
  modified_base (204)..(204): a, c, t, g, unknown or other
  misc_feature (204)..(204): n is a, c, g, or t
  modified_base (283)..(283): a, c, t, g, unknown or other
  misc_feature (283)..(283): n is a, c, g, or t
tcagtacgctgtctcacgaccggtgctcgatttagcgagacgcgcaggggcgtcagagaggagccttagccctggactccaaggcctttccacttggtgatcagcactgagcacagaggactcaccgatggaattggggctgagctgggttttccttgtgctagttttagaggtgtccagtgtgacgtgcaactggtgagtcgngggggagcttggtccagtccgtggggtcctgagtactctccgtgtgcagtccctcgtggacttcgtaacgttggtaacncttagttggacttggtacgtcggttccgcccgtgttaccgtccgaaggggtacggggccttagggaggttggggtacggcccgtaacgtacgttacgaacggggtaggtaggtacgggtaaaccgtaaaaaagttgtacgttacgggactaacgttcggttagggacccgggtacggttaaacgtcccgtaacccgaagttccgtaccgaggaacgtaacgaaaccgtaaaccctaaaacgtaccgtacgttaagtacgtacctggaacgtaagtcgggtaccggtccgttagacgtaccacggtaacgaccgaacggtctagttcgttaagttcgtagtgaccggtagtagtaacgttggaacttacgtaagttcgaacgttgtacgtaggtatgtacgtgttag

SEQ ID NO: 168097 - DNA, 568 bp, Homo sapiens
  misc_feature: GYAE6OF01CF0MY.37.10.A10.1.454.CMB.1.raw
tcagtagtgtagatcacgaccggtgctcgatttagcgtcgatctcagggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcgtacgaatttgtggaccctttgactactggggccagggaaccctggtcaccgtctcctcagccctccaccaagggcccatccggtccttccccctggccgccctgcctccaggacgccgaccctccgagacgccacacggccggccccgtgggcctcggcccgtggtccaaacggtacctaccgttcccaacgtcctaacctactaacctcggaacggccgggctcgggacaagggccgcagtacg

SEQ ID NO: 168098 - DNA, 599 bp, Homo sapiens
  misc_feature: GYAE6OF01BVY5D.37.10.A10.1.454.CMB.1.raw
  modified_base (438)..(438): a, c, t, g, unknown or other
  misc_feature (438)..(438): n is a, c, g, or t
tcagtagtgtagatcacgaccggtgctcgatttagcgtcgatctcagggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaaatcaaaaaaccaccctgtatctgcacatgaacagcctgacaaccgagacacagccgtctattactgtgtcatagatgattactttgataccagcgtacgaatttgtggaccctttgactacgtgggccagggaccctggtcaccgtctcctcacgcctccaccaacggcccatccggtccttcccctggccgccctcgcctccgaggcnccaccgtccgagacgccacgacgccggcccgtgggccttcggcccttgggtaccaaacgggtaccttaaccgttcccgaacttcccgtaacctaacccttaacgtcggaacgggtcccggggtccgttacggggaccgaaagggccgaccgtaagtaacgg

SEQ ID NO: 168099 - DNA, 608 bp, Homo sapiens
  misc_feature: GYAE6OF01BWGKY.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgagacacagccgtctattactgtgtcatagatgattactttgataccagcggtacgaatttgtcggtaccctttgacctacgtggggccagggaacccctggtccaccgtctcctcacgccctccaccaacggccccactccggtccttcccccgtcggccgcccctcgcctcccgacggacgccacccgtcccgacgacgccacgacggcccgggcccgtcggggcctcggcccgttcgggtaccgaacggtaccttaccttacccgtaacttacctacctaccttacgtcggacggtccggggccgttacgggaccgaaagggccgcgagtacg

SEQ ID NO: 168100 - DNA, 575 bp, Homo sapiens
  misc_feature: GYAE6OF01EOORZ.37.10.A10.1.454.CMB.1.raw
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
tcagtagtgtagatcacgaccggtgctcgattttagcgtcgatctcaggggtcccgttacactctcctgtgccagcctctggattcagtttctataccgcctggatgagctggatccgccaggctccaggaagggctggagtgggtcggccgtagtaaaagcgaaggttctggtgggacaacagactacgctgcccccgtgaaaggcagattcaccatctcgagagatgaatacaaaaaccaccctgtatctgcacatgaacagggcctgacaaccgaggacacagccgtctattactgtgtcatagatgtatttactttgataccagcggtacgtaatttgtcggtaccctttgactacgtggggaccacgggaaccctggtccaccgtctcctcacgccctccaccgaacggcccacgtccgtccttccccgtcgccgccctcgtcctccgacgacgccacctccgacgacgcacgacgccggcccgtcggtcgtcgtccgtcggcgttttttaacgacttaccttacctactactactactactcgacgcggcgtcggacgagcgngngtag

SEQ ID NO: 168101 - DNA, 516 bp, Homo sapiens
  misc_feature: GYAE6OF01C8TJI.37.10.A10.1.454.CMB.1.raw
  modified_base (505)..(516): a, c, t, g, unknown or other
  misc_feature (505)..(516): n is a, c, g, or t
tcagtagtgtagatcacgaccggtgctcgatttagcgtcgatctcaggggtcccttacactctcctgtgcagcctctggattcagtttctataccgcctggatgagttggatccgccaggctccagggaaggggctggagtgggtggccaacataaagcgagatggaagcgagaaatactatgtggactctgtgaggggccgattcaccatctccacagacaacgccaagaaaatcaaattctttttgacaaatgaacagtctgagagtcgaggacacggccatgtattactgtacgagagaacagacttggggccagggaccctggtcaccgtctcctcagcctccaccaacgggcccactccggtccttccccctggcccgccctgcctccgaggacgccaccctccgacgacgccacgacggccggcccgtgggcctcgccgttgggtcaacggacctacttccatctaacactactgagcgggctggcaaggcgcagtagnnnnnnnnnnnn

SEQ ID NO: 168102 - DNA, 573 bp, Homo sapiens
  misc_feature: GYAE6OF01A912E.37.10.A10.1.454.CMB.1.raw
  modified_base (336)..(336): a, c, t, g, unknown or other
  misc_feature (336)..(336): n is a, c, g, or t
  modified_base (451)..(451): a, c, t, g, unknown or other
  misc_feature (451)..(451): n is a, c, g, or t
  modified_base (568)..(568): a, c, t, g, unknown or other
  misc_feature (568)..(568): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtggacaacagactacgctgcccccgtgaaaggcagattcaccatctcgagagatgaatccaaaaaccaccatgtatctgcacatgaacagcctgacaaccgaggacacagccgtctattactgtgtcatagatgatttactttgataccagcggtacgaatttgnggaccctttgactactgggccagggaaccctggtcaccgtctcctcacgcctccaccgaacgggcccctagtccggtccttccccccgtggcccgcccctcgcctccgacggacnccaccctccgagacgcacgacggccggcccgtcgggcctcggcccgtggtaccaagggtaccttaccttccactcctaacacttactgacggccgggcgtcgggaccaacgggccgngtacg

SEQ ID NO: 168103 - DNA, 567 bp, Homo sapiens
  misc_feature: GYAE6OF01B2AE9.37.10.A10.1.454.CMB.1.raw
  modified_base (452)..(452): a, c, t, g, unknown or other
  misc_feature (452)..(452): n is a, c, g, or t
  modified_base (559)..(559): a, c, t, g, unknown or other
  misc_feature (559)..(559): n is a, c, g, or t
tcagtagtgtagatcacgaccggtgctcgatttagcgtcgatctcagggtcccttacactctcctgtgcagcctctggattcagtttctataccgcctggatgagctggatccgccaggctccagggaaaggggctggagtgggtcggccgtagtaaaagcgaaggttctggtgggacaacagactacgctcgcccccgtgaaaggcagattcaccatctcgagagatgaaatacaaaaaccaccctgtatctgcacatgaacagcctgaacaacgagacacagccgtctatactgtgtcatagatgtatttacttgactacgagcgtagaatttcgtcggtacccttgactacgtgggcctacggacctgtccaccgtctcctcacgccctaccgaaccgacggccctatccgtcccttccccgtcggccgcccgtcgctaccgacggacnccgaccgtccgaagacgaccacgacggcccggccgtgggcctcgccgtggacaacggtactacctccactccactactacgtcgtacggcggcgtcggacgaaggcncgtagtag

SEQ ID NO: 168104 - DNA, 521 bp, Homo sapiens
  misc_feature: GYAE6OF01A08CA.37.10.A10.1.454.CMB.1.raw
  modified_base (435)..(435): a, c, t, g, unknown or other
  misc_feature (435)..(435): n is a, c, g, or t
  modified_base (517)..(518): a, c, t, g, unknown or other
  misc_feature (517)..(518): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcggtacgaatttgtgggacccctttgactactggggccagggaaccctggtcaccgtctcctcagcctccaccaagggcccatcggtcttcccctggcgccctgctccaggancacctccgagagcacagccggccctggggctgcctggtcaacggctacttccatcctacactactgagcggctggcaaggcnntag

SEQ ID NO: 168105 - DNA, 560 bp, Homo sapiens
  misc_feature: GYAE6OF01EI2YY.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaaccaccctgtatctgcacatgaacagcctgacaaccgaggacacagccgtctattactgtgtcatagatgattacttgatacagcgtacgtaatttgtcggtaccctttgactacgtggggccagggaaccctggtccaccgtctcctcacgccctccaccaacgggccccacgtccggtccttcccccgtggccgccctgccctccgaggacgccacctccgagacgcacgacgccggcccgtgggctcgcctggtcaacggtctacttccatacctactactacgtcgaggtccgggactcgggacgaaggcgcgagtacg

SEQ ID NO: 168106 - DNA, 620 bp, Homo sapiens
  misc_feature: GYAE6OF01DE5PU.37.10.A10.1.454.CMB.1.raw
  modified_base (618)..(618): a, c, t, g, unknown or other
  misc_feature (618)..(618): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgacaaccgaggacacagccgtctattactgtgtcatagatgattactttgataccagcggtacgtaatttgtgggaccctttgactacgtggggccagggaaccctggtcaccgtctcctcacgcctccaccgaacggcccacgtccggtccttcccccgtcggccacccttccctacccaacgacgcctaccctcgtcggggcaccgacgccggcccgtcgggtcctcggtcccgttcgggtaccgtaaacggtaccttaaccgtttcccgaacttccctaacctaaccgtaaccgttaggacgggtccggggtaccgtcgggaccgtaacgggaccgacgtaacgtcggncg

SEQ ID NO: 168107 - DNA, 592 bp, Homo sapiens
  misc_feature: GYAE6OF01DXLBX.37.10.A10.1.454.CMB.1.raw
  modified_base (456)..(456): a, c, t, g, unknown or other
  misc_feature (456)..(456): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaaccaccctgtatctgcacatgaacagcctgacaaccgaggacacagccgtctattactgtgtcatagatgatttactttgataccagcggtacgtaatttgtcggtacccctttgactacgtggggccagggaaccctggtcaccgtctcctcacgtccctaccaccgaacgggccctagtccggtccttcccccgtggccgtccctgcctccaggacnccaccctccgagacgccacgacgccggcccgtggggcctcggcccttagggtccaaacggtaccttacgttccccaagttccctaactaaccttacgtgacggtccgggacttcgggaccaagggccacgagtacg

SEQ ID NO: 168108 - DNA, 482 bp, Homo sapiens
  misc_feature: GYAE6OF01CE2AQ.37.10.A10.1.454.CMB.1.raw
  modified_base (372)..(372): a, c, t, g, unknown or other
  misc_feature (372)..(372): n is a, c, g, or t
  modified_base (473)..(482): a, c, t, g, unknown or other
  misc_feature (473)..(482): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtctcccctggcnccctgcctccaggacgcacctccgagagcacagcggccctgggctgcctggtcaaggctactccatcctacactactgagcgggctggcaaggcgcatagnnnnnnnnnn

SEQ ID NO: 168109 - DNA, 563 bp, Homo sapiens
  misc_feature: GYAE6OF01E4U9K.37.10.A10.1.454.CMB.1.raw
  modified_base (387)..(387): a, c, t, g, unknown or other
  misc_feature (387)..(387): n is a, c, g, or t
  modified_base (557)..(557): a, c, t, g, unknown or other
  misc_feature (557)..(557): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcggtacgtaatttgtggacccctttgactacgtggggccagggaaccctggtcaccgtctcctcngcctccaccaacgggcccatccggtccttcccccgtcggccgccctcgcctccaggacgccaccctccgacgacgccacacgccggcccgtgggcctcgccgtggtaccgaacggtacctaccttcccacttccgtaccactactgacgccgggcgtcggacaaggccgngagtag

SEQ ID NO: 168110 - DNA, 556 bp, Homo sapiens
  misc_feature: GYAE6OF01A6NQK.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattacttgataccagcggtacgaatttgtcgggacccctttgactacgtggggccagggaaccctggtcaccgtctcctcagcctcaccacggccactcgtcttccccctcggccgccctcgcctccgaggacgccaccctccgagacgccacgacgccggcccctggggcctcggcccgtgggtaccaagggaccttaccttacccagtcctacgactactgacgcgggctgggcaacgggcgcagtag

SEQ ID NO: 168111 - DNA, 550 bp, Homo sapiens
  misc_feature: GYAE6OF01BPLYM.37.10.A10.1.454.CMB.1.raw
  modified_base (470)..(470): a, c, t, g, unknown or other
  misc_feature (470)..(470): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgatttactttgataccagcggtacgtaatttgtcgggtacccctttgactacgtggggccagggaaccctggtcaccgtctcctcacgcctccaccgacggcccatccggtccttcccccgtggccgccctcgcctccgaggacgccaccctccgagacgccacncgccggcccgtgggcctgccgtggcaaggctacctccatcctactactacgtgacggcgggctcggacaaggcgcagtag

SEQ ID NO: 168112 - DNA, 615 bp, Homo sapiens
  misc_feature: GYAE6OF01DSRWT.37.10.A10.1.454.CMB.1.raw
  modified_base (288)..(288): a, c, t, g, unknown or other
  misc_feature (288)..(288): n is a, c, g, or t
tcagtagtgtagatcacgaccggtgctcgatttagcgtcgatctcagggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgaacaaccgaggacacagccgtntattactgtgtcatagatgaatttactttgactaaccagacggtacgtaatttgtcgggtacccctttgactacgtggggaccagggtaaccctggtccacccgtctcctcacgccctaccaccgaacgggcccactccggtccttcccccgtcggccgcccgtcgccctcccgtaggaccgccacccgtcccgaacggacgaccacgaacggcccggacccgtcggggctcgccgtaggtaccgaacggtacccttacctaccctacgttacctaacctaccttacgtcggacggccgggcgtcgggacgaacggcgcgtaagtag

SEQ ID NO: 168113 - DNA, 558 bp, Homo sapiens
  misc_feature: GYAE6OF01B13JV.37.10.A10.1.454.CMB.1.raw
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaaccaccctgtatctgcacatgaacagcctagaacaaccgaggacacagccgtctattactgtgtcatagatgattactttgataccagcggtacgtaatttggtcgggtacccctttgactacgtggggccagggaccctggtccaccgtctcctcacgccctccaccgaacggcccagtccggtccttcccccgtggccgccctgcctccgaggacgccacccgtccgagacncacncggccggcccgtgggcctgccgtggtcaaggacctacttccatcctactactactgacgccggctcggacaaggcngngtcg

SEQ ID NO: 168114 - DNA, 572 bp, Homo sapiens
  misc_feature: GYAE6OF01CAXIC.37.10.A10.1.454.CMB.1.raw
  modified_base (427)..(427): a, c, t, g, unknown or other
  misc_feature (427)..(427): n is a, c, g, or t
  modified_base (567)..(567): a, c, t, g, unknown or other
  misc_feature (567)..(567): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgagacacagccgtctattactgtgtcatagatgattacttgataccagcgtacgaatttgtggaccctttgactactggggccagggaacctggtcaccgtctcctcagcctaccaccgaacgggccctaagtccggttacttcccccgtggccnccctgcccttccgaggcaccaccctccgaagcgtaccactacggccggtaccctggggctcgccgttgggacaacggaccttacttccgaattccctaacgtactaccgtggacgtccgggctcgggacaaagggcacgngtacg

SEQ ID NO: 168115 - DNA, 590 bp, Homo sapiens
  misc_feature: GYAE6OF01B7XU3.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaaatacaaaaaccaccctgtatctgcacatgaacagcctagacaaccgagacacagcctctattactgtgtcatagatgattactttgataccagcggtagtaatttgtcggtaccctttgactacgtcggggccagggaaccctggtcaccgtctcctcacgccctccaccgaacgggcccacgtccggtccttcccccgtggcccgccctcgcctcccgaggacgccacccgtccgagacgcacgacggccggcccgtgggcctcggccgtcgggtacaaacggtaccttaccgttcccaagttcctaacctacctacgtcggacggcgggccgtacgggacaaagggccgacgagtacg

SEQ ID NO: 168116 - DNA, 711 bp, Homo sapiens
  misc_feature: GYAE6OF01AOV46.37.10.A10.1.454.CMB.1.raw
  modified_base (296)..(296): a, c, t, g, unknown or other
  misc_feature (296)..(296): n is a, c, g, or t
tcagtagtgtagatcacgaccggtgctcgatttagcgtcgatctcagggtcccttacactctcctgtgcagcctctggattcagtttctataccgcctggatgagctggatccgccaggctccaggaaaggggctggagtgggtcggccgtagtaaaagcgaaggttctggtgggacaacagactacgctcgcccccgtgaaaggcagattcaccatctcgagagatagaatacaaaaaccaccctgtatctgcacatgaacagcctgacaaccgaggacacagccgtctattacngtgtcatagatgtatttacgtttgataccaggtcggtaacgtaagtttgtcgggtaccctttagacgttacgtcggggacccgaacgggtaacccctggtcctacccggttcctaccgtcgacgtccctaccctaccgaaccgggtcccctaacgttcccggttccccctttccccccgtcggtcccgtaccccgtcgtacccctacccggacggaccgtcccaaccccgtcccggaacgaccgacccacggaaccggccccgggtccccggtcggggtcccttccgggacccgttacgggtaccaaaccgggtacctttaccttacccgtacttacccgtaaccgtaccttaacggtcgggtaacggtcccggggtactaccggggacgaaaccggggccgtaaccgagtacgg

SEQ ID NO: 168117 - DNA, 591 bp, Homo sapiens
  misc_feature: GYAE6OF01CTZ6V.37.10.A10.1.454.CMB.1.raw
  modified_base (552)..(552): a, c, t, g, unknown or other
  misc_feature (552)..(552): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgacaaccgaggacacacgccgtctattactgtgtcatagatgatttactttgataccagcgtacgaatttgtggtacccctttgactacgtggggccagggaacctggtcaccgtctcctcacgccctaccaccgaacgggcccctagttccggtcccttcccccgtggcccgtccctcgcctccgaggacgccaccgtccgagacgccacgacggccggcccgtggggcctcggcccgtgggtccaaacgggtaccttaccttcccaattccgtaaccacttacgnggacgccggggactgggacctaagggccgtcgagtacgg

SEQ ID NO: 168118 - DNA, 727 bp, Homo sapiens
  misc_feature: GYAE6OF01C67B1.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccgagggaaaggggctggagtgggtcggaccgtaagtaaaagcgaaggttctggtgggacaacagactacgctcgccccgtagaaggcagatcacatctcgagagatagaactaacaaaaacctaccctagtactctagacaacatacgaaacacgacctagaaccgaaaccggagacacgacgtccgtactacttacgtgtgtacatagatagtattactttagaactacgacgtacggttaacgtaagttttcggtacgggttacccctttaggaaccgtacggtacgggggacccgtaaccggggaaccccgttcgggtaccgaacccgttcctcccgtacgacccgtccctacccgaacccgtaaccgggacccctaacgtttccccggttcccttacccccgtcggcccgtcccgtacgcccgtacgacggacgacccaccgtccggaagacgaccaccggacgcccggtccgtcgggccgttcgacccgttacggaccgtaaacgtaccttaccttacccgtaacttacccgtaacctaaccgttacggtacgggtaccggtccgggacggtacgggacgaacgggccgtagagttacg

SEQ ID NO: 168119 - DNA, 600 bp, Homo sapiens
  misc_feature: GYAE6OF01BY6UY.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgacaaccgagacacagccgtctattactgtgtcatagatgatttacttgataccagcgtacgtaatttgtcggtaccctttgactacgtcggggccacgggaaccctggtcacccgtctcctcgactccctaccaaccgaacggccctacgtccggttcccttcccccgtcggcccgtcccctcgccctccgaggccgccacccgtccgagacgccacgacggcccggcccgtggggcctcggcccgttgggtaccaaacggtccttaccgttccaacttctaacctacttacgtggacgggccgggcgtcgggacgaaacgggcacgagtacg

SEQ ID NO: 168120 - DNA, 709 bp, Homo sapiens
  misc_feature: GYAE6OF01B7YHP.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatagaatacaaaaaaccacccctgtatctgacacatgaacagcctagaccaaccgaggacacagccgtctattactgtgtcatagatgtatttactttgactacagtacgtacgtaattttggacgggtaccctttgaccgtacgtcggggaccgtacgggtaaccctcgggtcctacccggtctacccgtcacgtaccctacccgaaccgaacgggtcccctacgttccggtcccttacccccgtcggaccctccccgtcgccctacccggaggtaacccgccgaacccgtccggaagaccgcccgaaccgacgggacccggtccccggtaggggcccttacggcccgttacgggtaccctaaacgggttcccttaaccgttaccccaacgtttacccgtaacccgttaacccgttaacggtcgggaaccgggtccggggtacttacggggacccgaaacggggtccgaccggtaagtaccgg

SEQ ID NO: 168121 - DNA, 677 bp, Homo sapiens
  misc_feature: GYAE6OF01DVI5P.37.10.A10.1.454.CMB.1.raw
  modified_base (214)..(214): a, c, t, g, unknown or other
  misc_feature (214)..(214): n is a, c, g, or t
  modified_base (274)..(274): a, c, t, g, unknown or other
  misc_feature (274)..(274): n is a, c, g, or t
  modified_base (502)..(502): a, c, t, g, unknown or other
  misc_feature (502)..(502): n is a, c, g, or t
  modified_base (533)..(533): a, c, t, g, unknown or other
  misc_feature (533)..(533): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccgagggaaagggcgtggaggtgggtcggccgtaagtaaaagcgaaggttctggtgggacaacagactacgctcgccccgtagaaaggcagntcacatctacgagagatagaactaacaaaaaccctacctagtatctcgacacatagaacncgacctagaaccaacgagacacacgccgtacttatacgtgtgtacagtatatagtatttacttagactacgaggtcgtaagttaagtttcggtacggttacccttagaccgttacggtacggaccggtaacggtacccgttggtaccctaccggtcctccgtacgccgtacccaccgaaccgacggtccctacgtccccgttccccttccccggtaggccccttcccncgtccgaccgaggtcccacccgtacgaccgngaacctccgacgtaccggtcccggaccggtcggtaccgtccggtaccgtgggtaacccgaacgttacccttaccgttaccctacgtaacccgtacctacgtacggtggacccggtcgggaccgtcgggacacggcgaactagcg

SEQ ID NO: 168122 - DNA, 603 bp, Homo sapiens
  misc_feature: GYAE6OF01C7UXB.37.10.A10.1.454.CMB.1.raw
  modified_base (294)..(294): a, c, t, g, unknown or other
  misc_feature (294)..(294): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaaatcaaaaaccaccctgtatctgcacatgaacagcctgacaaccgagacacagccgtctattacngtgtcatagatgattactttgataccagcgtacgaatttcgtggtaccctttgactacgtggggccagggtaaccctggtccaccgtctcctcagtccctaccaccgaacgggcccactccgggtccttcccccgtggtccgccctgccctcccgaggtaccgcaccctccgagacgccacgacgaccggcccgtcgggtcctcggcccttggtacctaacgggaccttacccgttacctactccgtaacaccgttaacgtcggaacggtccgggacgttcgggaacgtaagggccgcgtaagtaacgg

SEQ ID NO: 168123 - DNA, 785 bp, Homo sapiens
  misc_feature: GYAE6OF01B9AYS.37.10.A10.1.454.CMB.1.raw
  modified_base (241)..(241): a, c, t, g, unknown or other
  misc_feature (241)..(241): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtgggacaacagactacgctgcccccgtgaaaggcagattcaccatctacgagagatgaatacaaaaaccnccctgtatctgcacatgaacagcctagaccaaccgaggacacagccgtctattactgtgtcatagatgtatttactttgactaccagtacggtaacgtaagtttcggtcggtacccctttgaaccgttacggtcggggacccgaacgggtaaccccgttcggtacctacccgttcctcccgtcgacgtcccctacccgaacccgaaccgggtccccctacggtttccccgggttaccccctttcccccccggtcgggtcccccgtcccccgtttcggccccgttaccccggaacggggacccgtacccccgtaacccccggttaccgggaacgtaacccggcccgtaaaccggacccgggtcccccggggtacccccggttcgggggtaccccttcgggtccccggttagggttaacccggaaacgggttacccctttacctttacccgaaactttccccgtaaaccgtaaccgttaaccggttgggaaccgggtccggggtaccgtacggggtaacccgaacgggccgtaagtaacggtacgg

SEQ ID NO: 168124 - DNA, 728 bp, Homo sapiens
  misc_feature: GYAE6OF01B8BQ5.37.10.A10.1.454.CMB.1.raw
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgccccgtgaaaggcagattcaccatctcgagagatgaactacaaaaaccaccctgtactctgcacatagaacagcctgacaaccgagacacagccgtntattacngtntcatagatgtatttacttgactaccagtacggtacgtaatttcggtacggtacccctttggactacgtggggacccgtacgggtaacccgtggtcccgaaccgtcctaccctcgacgtccctaccgaaccgaacgggcccctaagttcccgggtacccctttccccccggtggccccgtccccgttcgaccccgttcccgaagggtacccgacccgtacccgtccggaacggtacggacccgaacggcgggtaccccggccccggtaggggtcccttccgggtacccgtttaccgggtaccggtaaaacggttacccgttaccgttacccgtaacgttacccgttaacccgtaaccttaacccggttcggtaacccggggtacccgggtcggttaacgggacccggtaacggaccggtcgaacgttacg

SEQ ID NO: 168125 - DNA, 571 bp, Homo sapiens
  misc_feature: GYAE6OF01EAHTB.37.10.A10.1.454.CMB.1.raw
  modified_base (451)..(451): a, c, t, g, unknown or other
  misc_feature (451)..(451): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaaccaccctgtatctgcacatgaacagcctgacaaccgagacacagccgtctattactgtgtcatagatgtattactttgataccagcgtacgtaatttgtcggtaccctttgactacgtggggccaggaaccctggtccaccgtctcctcacgtcctaccaccgaacgggccctagtccggtccttcccccgtgccgccctgcctcgaggacnccacccgtccgacgacgccacgacgccggcccgtcgggcctcggcccgtggtaccgaacggtacctaccgttccaatcctacactacgtgacggcggctcggacgtaggccgngngtacg

SEQ ID NO: 168126 - DNA, 598 bp, Homo sapiens
  misc_feature: GYAE6OF01C8EAA.37.10.A10.1.454.CMB.1.raw
  modified_base (456)..(456): a, c, t, g, unknown or other
  misc_feature (456)..(456): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaaatacaaaaaccaccctgtatctgcacatgaacagcctgacaaccgaggacacagccgtctattactgtgtcatagatgtattacttgataccagcgtacgtaagtttgtcggtaccctttgactacgtcggggccgacgggaaccctggtccaccgtctcctcacgccctccaccgaacggccccattccggtccttccccgcggccgccctcgcctccgaggacnccaccgtccgacgacgccgacgacgcccggcccgtcgggccgtcggccgttaggtacgaacggtaccttaccttcctactaccgtaacctaaccgttactgggacggtccgggccgtacgggaccgaagggccacgagtacg

SEQ ID NO: 168127 - DNA, 618 bp, Homo sapiens
  misc_feature: GYAE6OF01A830V.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctcgcccccgtgaaaggcagattcaccatctcgagagatgaatacaaaaaccaccctagtatctgacacatagaacagcctgaaccaaccgaggaacacacgccgtactattactgtgtcatagatgtattacttgactaccagtcggtacgtaatttcggtcggtaccctttagacgtacgtcggggaccaacgggtaccccttggtacctacccgtcctcctacgacgtccctacccgaaccgaacgggtcccctacggttcccggttccccttcccccgtcggcccgtcccgtcgtccctccgaggaccgcctacccgtccgagacgaccacgacggccggtcccgtgggcctcgccgtggactacgtacctactaccactacctactactacgcggacgcggcgtcggacgtaaggcagtagtcg

SEQ ID NO: 168128 - DNA, 762 bp, Homo sapiens
  misc_feature: GYAE6OF01ALKZ2.37.10.A10.1.454.CMB.1.raw
  modified_base (542)..(542): a, c, t, g, unknown or other
  misc_feature (542)..(542): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaaatacaaaaaccaccctgtatctgcacatgaacagcctgaccaacgaggacacagccgtctattactgtgtcatagatgtaatttacgtttagactaaccgagtacgggtaacgtaagttttcggtacgggtaccccttttagaccttacggtcgggggtacccgacggggtaaaccccgtcggtacctacccggttcctccctccgtaccgccccttcccgaacccgtaaccgggacccctaacgttccccgggttccccgtttccccccgtgggtcccgtcccccgtcgtacccgtacccgaacgggaccncccgtaccccgtaccggacgacgaccctaaccgcggaccccgggtcccggtcggggtccgtaccggtcccggttaacgggtacccgaaacgggttacccttacccgtttaccccgaacctttacccgttaacccgtaaccgtttaaccggtaccgggtaccgggtacccgggtaccggtccggggtaacccgaacgggtacccggtaaccgtaggtacgg

SEQ ID NO: 168129 - DNA, 747 bp, Homo sapiens
  misc_feature: GYAE6OF01E6B2A.37.10.A10.1.454.CMB.1.raw
  modified_base (295)..(295): a, c, t, g, unknown or other
  misc_feature (295)..(295): n is a, c, g, or t
  modified_base (742)..(742): a, c, t, g, unknown or other
  misc_feature (742)..(742): n is a, c, g, or t
tcagtagtgtagatcacgaccggtgctcgattttagcgtcgatctcaggggtccctttacactctcctgtgcagcctctggattcagtttctataccgcctggatgagctggatccgccaggctccgaaggaagggctggagtgggtcgaccgtaagtaaagcgtaaggttctggtagggacaacagactacgctccggccccgtagaaacgcagtacttccaccagttctacgacgatagtacgaactaaccaaacctaccgttgttaactccgagaccactaacgtacgaacnccgtaccgtaaccgtaaccggaaccggtaacgaccgaacgtaccgtaccgttaaccttacgttacgtacgtacgtacgtaattacgtaattacgtttaacgtttacgttacgaactacgggtacggttacgttacgttacgtcggttaccgtaccttacggacgacggtcgggaccgacgtaccgtcgtcctaccgtcctaccgtaccaccgtaccctacccggaccgaccgtaccctccggtacccgttcccgtcccggtcgtccgtcccgtcgaccgtaccgaggtacccgaccgtaccgacgaacgtaccgccggtaccggccggtaccggccggttaccggaccggtaccgtaccggtacgtaaccgtaccgttaccgtacgtttaaccgacttaccgtaaccgttcgacggttcgacgggcgacgtacggacgacgtcgtcngtacg

SEQ ID NO: 168130 - DNA, 616 bp, Homo sapiens
  misc_feature: GYAE6OF01C95BX.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgaacaaccgagacacacgccgtatattactgtgtacatagatgtatttacttgactacgagacggtacgtaagtttggtacggtaccctttgacgtacgtcggggccgacgggtaaccctcggtacctacccgtcctcctcgacgtcccacccgaccgaacgggtccccacgttcccgttcccttacccccgtggcccgcccgtgccctaccgacggaccgacccgaccgtaccgacgacgaccacgacggcccgggcccgtagggcctcggccgtacggtacaacggtaccttacctccatacctaacacttacgtgacgggtcggcgtacgggacaggtccgatgtacg

SEQ ID NO: 168131 - DNA, 675 bp, Homo sapiens
  misc_feature: GYAE6OF01EUGVS.37.10.A10.1.454.CMB.1.raw
  modified_base (261)..(261): a, c, t, g, unknown or other
  misc_feature (261)..(261): n is a, c, g, or t
  modified_base (334)..(334): a, c, t, g, unknown or other
  misc_feature (334)..(334): n is a, c, g, or t
  modified_base (671)..(672): a, c, t, g, unknown or other
  misc_feature (671)..(672): n is a, c, g, or t
  modified_base (674)..(675): a, c, t, g, unknown or other
  misc_feature (674)..(675): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggggaagggctggagtgggtctcgaggtattacgtggtagtggtaactaccgcatactacgcagactccgtgacgggccgttcaccgtctccagagacaattccaaagaataccggtctatcgtaggaaatgaacncgcctgagacgccggaggaccacggccctactattactgtgcgagagactgaggacggatatagcagcagctntcgactacggtcgggaccaaccggtaacccgtggtacctacccgttcttcccacgacgcccctacccgaacccgaaaccgggcccctaacggttcccggttaccccgttcccccgtccgggaccctacccctcccgtacccgaaacgaccgtccgacccgttccggtcggggaccgtaaccgaccggtcccggtcccggtcgggtcccttccggcccgtcggtaaccgtaacggtacccttaaccttcccgtaacttacctaaccgtactaccgtcggaccgggtaccgggccgttaccgggaccgaacgggccgacgaacgttacggactagacgnngnn

SEQ ID NO: 168132 - DNA, 788 bp, Homo sapiens
  misc_feature: GYAE6OF01DW068.37.10.A10.1.454.CMB.1.raw
  modified_base (432)..(432): a, c, t, g, unknown or other
  misc_feature (432)..(432): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccagggaaaggggctggagtgggtcggccgtagtaaaagcgtaaggttctggtagggacaacagactacgctcgcccccgtgaaaggcagattcaccatctcgagagatagaataccaaaaacctaccctgtactctgacaactatagaacacgtcctagaaccaaccggaggaccacgacgtccgtactaattaccgtgtacgtcaagtacgtatagtatttacttagactacgagtcggtactaagtttcgtacggtaccttagtacgtacgtcgggacctacgggtaaccctggtaccacccgttcnccctacaccgtccctacccgaacgtaaccgggccctaacgttccccggtttacccgttccccccgttacgggtccccgtccccgttccgtacccgttaccgaacgggtaccgtaaccccgtaccccggtaccggtaaccggaacgaccgaacccgtaacccgggccccgggtacccccggttccgggggtaccgttacccgggtaccccggtttaccgggtaacccggtaaaccgggttaaaccccgtttaccgtttaccccgaacgtttaccctaaaccgttaaacccgtacccggttacgggtaccgggacccgggtcggttacggaccggttaccgggaccgtatacgtacgg

SEQ ID NO: 168133 - DNA, 714 bp, Homo sapiens
  misc_feature: GYAE6OF01A7Z4N.37.10.A10.1.454.CMB.1.raw
  modified_base (376)..(376): a, c, t, g, unknown or other
  misc_feature (376)..(376): n is a, c, g, or t
  modified_base (458)..(458): a, c, t, g, unknown or other
  misc_feature (458)..(458): n is a, c, g, or t
  modified_base (712)..(712): a, c, t, g, unknown or other
  misc_feature (712)..(712): n is a, c, g, or t
tcagtagtgtagatcacgaccggtgctcgatttagcgtcgatctcaggggtcccttacactctcctgtgcagcctctggattctagtttctataccgcctggatgagctggatccgccaggctccgaagggaaaggggctggaggtggggtcggaccgtaaggtaaaagcggtaaggttcgtgggtgggaacaacaggactacgctcgccccgtaggaaaggcagacctcgaccatctcgagagactagaactaaccaaaaacctacctgtactactcgaccagtaatcggaaacacgccctagaaccgaaacggaggaacctacgacggttccgtactaatttcgtgtgtactagtagtctagtactttacttanaacgttaccgaggtccgttaagttaacgttgggtaccggttaccttagacgttacgggcgggaccgtacggacctacggtcnccgttacctccggtcaccgtacctaccggaaccgtccggaccctcgttacccgtccccgtttcccgcggtccctccgtaccgtccgtccgaacggcgttcccacgtaccgacgacgacccgtacgaaccggtcccgacggtccggacgtccggtacgtccggtaacggaacgtccgttaacctaccgtaccttacccggtaactacgtacggtcgtaccgggccgtacgggccggacgaccggttcgacggtancg

SEQ ID NO: 168134 - DNA, 651 bp, Homo sapiens
  misc_feature: GYAE6OF01E1VPV.37.10.A10.1.454.CMB.1.raw
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctcgcccccgtagaaaggcagacttcaccatctcgagagatgaaactaccaaaaaaccaccctagtatctgcacatgaacagcctagaacaaccgaggacacacgccgtactattactgtgtcatagatgtacttactttgaactaccagtcggtaacgtaatttggtcggtaccctttgaccgtacgtcgggaccacgggaaccctggtaccaccgtctcctacacgccctaccaacgacggcctacgtccgtccttcccccgcggtccncccgtcgcctccgacgacnccgaccgtacgacgacgaccgacgaccgggccggtccccgtcggggtcctcggtcccgtacggtaccggaaaccggtaccttacccgttacccaacttaccgtaacctacgtaccgttacgggaacggaccggggtcctacggggaaccgaacgggccgtaagtacgtaacg

SEQ ID NO: 168135 - DNA, 760 bp, Homo sapiens
  misc_feature: GYAE6OF01EB8I4.37.10.A10.1.454.CMB.1.raw
  modified_base (754)..(754): a, c, t, g, unknown or other
  misc_feature (754)..(754): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaagggctggagtgggtcggccgtagtaaaagcgaaggttctggtgggacaacagactacgctcgccccgtgaaaggcagattcaccatctcgagagatagaactaccaaaaaccaccctgtactctgcacatacgaacacgcctacgaaccaaccggaggaaccacacgcctactattacgtgtgtacatagtatgtactttacgtttacgactaccgaagtacggttaacgttaattttcggtaccgggttacccctttagaaccgttacggtcggggacccgtaaccgggtaacccgttcgggttaccgtacccgttcctcccgtaccgacgtaccccgtacccgaacccgtaacgggccccttaaccggttcccgggttccccctttacccccggtggacccgtccccgttcggccccttaccggaaccgggtacctacccgtacccgtaccggaggaccgtaccgaaccgccgggtacccgggtccccggtaggggtccttccgggaccgtttacgggtaaccgtaaccgggtacctttacccgttacctaacgttcccgtaaccgtaacccgtacgtcgggaccggccggggtaccttaggggaccctaacggggcctacgngtacgg

SEQ ID NO: 168136 - DNA, 727 bp, Homo sapiens
  misc_feature: GYAE6OF01EDI0S.37.10.A10.1.454.CMB.1.raw
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (723)..(723): a, c, t, g, unknown or other
  misc_feature (723)..(723): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccagggaaagggctggagtgggtcggccgtaagtaaaagcgaaggttctggtgggacaacagactacgctcgccccgtagaaaggcagacttcaccatctcgagagatagaatacaaaaaccaccctagtatctgacacatagaacacgcctagaaccgaaccgaggacacgacgccgttacttattacgtgtgtactataagtatagtatttactttagaactaccgaggtacggttaacgttaagtttaggtaccgggttacctttacggtacgttaccggtcggggaccgtaacgggtacccgttcggtaccgtaccgttcctaccctacgaccgtccctacccgaaccggaccgggtacccttacgttccccgtttccccttccccggnggtcccnccccgtagccgtacccgaggtacccgaccgtacccgtacggacgaccgtaccgaccgtaccgggccccgggtacccgtggggtcctcccgggtaccttacggggtaccgtaaacggttcccttaacccgttcctaacgttccctaacccgtacgttaccggcggacggggtccgtacggtaccggaacggacgtcgtaagngtgg

SEQ ID NO: 168137 - DNA, 729 bp, Homo sapiens
  misc_feature: GYAE6OF01B9BHH.37.10.A10.1.454.CMB.1.raw
  modified_base (722)..(722): a, c, t, g, unknown or other
  misc_feature (722)..(722): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcacccgtgaaagcagatcaccatctcgagagatagaatacaaaaaccacctgtaatctgacacatgaacagcctagacaaccgagacacagccgtactattactgtgtcatagatgatttacttagactacgagacggtaacgtaattttggtacggtaccccttttgaaccgtacgtcggggacccaacgggtaacccgttggtaccaacccggttccttacccgttaccgaacggtaccccgttacccgaaccggaaaccggggtccccctaagttccccgggttcccctttcccccccggtgggccccgtcccccgtaggaccccttacccggaacgggaccgtacccgtaaccccgttacccggaagaaccgaccgtaaccgaaccgggtccccgggccccgggtttcgggcccttacgggaccccgttagggtaacccgaaacgggttaaccctaccttacccgaacttaccttaacccgaacttaccgtaggaccggccggggtactacggacgtaacgggccngtaaacg

SEQ ID NO: 168138 - DNA, 761 bp, Homo sapiens
  misc_feature: GYAE6OF01B2Q03.37.10.A10.1.454.CMB.1.raw
  modified_base (312)..(312): a, c, t, g, unknown or other
  misc_feature (312)..(312): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggaggtgggtcggccgtagtaaaagcgaaggttctggtgggacaacagactacgctcgcccccgtgaaaggcagattcaccatctcgagagatgaatacaaaaaccaccctgtactctgacacatagaacagcctagaaccaaccgaggacacacgtccgtactaacttacgtgtntacaatagatgtaatttactttgaactaccgagtacggttaacgtaagttttcggtaccgggtaaccccttttgaaccgttacggtacgggggacccgtaacggggtaaccccgttgggtaccctacccggttcctacccgtacctacgcccctaacccgaacccgaaccgggtcccctaaccggtttccccgggttacccctttccccccggtacgggccccgtccccgtacgtccccgttaccggacgggacccgaccctaccccgtacggaacgtaccgaccctaaccggacgggtcccggtcccggtacgggtcccgtaccggtcccggttacgggtacctaaaccgggttacccttaccgtttacccacgtttaacccgtaacgtaacccgtaccgttacggaccggtccgggtacgtacggaccggaacggcctagacgtacg

SEQ ID NO: 168139 - DNA, 775 bp, Homo sapiens
  misc_feature: GYAE6OF01A204K.37.10.A10.1.454.CMB.1.raw
  modified_base (246)..(246): a, c, t, g, unknown or other
  misc_feature (246)..(246): n is a, c, g, or t
  modified_base (630)..(630): a, c, t, g, unknown or other
  misc_feature (630)..(630): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctgggtgggacaacagactacgctcgcccccgtagaaaggcagattcaccatctacgagagatgaactacaaaaaccncctgtatctgcacatagaacacgccgtacgaaccgaaccggaggtaccacgtacgtaccgttacttacgttacgtaggtctacgtaagtagtagttagttaacttttacgttagtaactaccgtacggtacggttaacgttagtttcgggtacccggttaccgttagtaccgtacggtaccgggaccggtaccggtacccgtcgtaccgtacccgtcctcctaccgaccgaccctaccgaacccggtacggtccccttacggttccccgttcccccttaccccgggcggtcccctaccccgttgccccgtaaccggaacggtacccaccccgtacccggtccgaaggacccgacccgtacggtcccgggacccggttcccgggngggtaccgtcccggttacgtacggtaaccgtaacgttaccccttacgtacccgaactttacccgaacccgtttagggtaccgtaccgggggtccgggtacccgggttacgggtaacccggaacgggacccgtccgaagttgacgg

SEQ ID NO: 168140 - DNA, 590 bp, Homo sapiens
  misc_feature: GYAE6OF01DTQFI.37.10.A10.1.454.CMB.1.raw
  modified_base (180)..(180): a, c, t, g, unknown or other
  misc_feature (180)..(180): n is a, c, g, or t
  modified_base (243)..(243): a, c, t, g, unknown or other
  misc_feature (243)..(243): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (539)..(539): a, c, t, g, unknown or other
  misc_feature (539)..(539): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggcgtagtaaaagcgaaggttctggtgggacaanagactacgctgcccccgtgaaaggcagattcaccatctcgagagatgaaataccaaaaaaccnccctagtatactagacaacatacgaaacagcctacgaacaaacccggaagaccaacaagcctatatactgtgtcaatagatgattacttgataccagacgtacgtaatttgcggtacccttagactacgcgggtccaagggtaaccctggctaccgtcctcgtcacgctacccacgaacggcccctagtccgtccttacccccgtggccctcccagtccctacgnggacncctaccgccgagacgcacgaacgccggcctgggacctgacgtcggtacgaaggtaccttactccanccgtaaccgacttacgtgacggtacgggtcacggtacgaaggcatagtacg

SEQ ID NO: 168141 - DNA, 835 bp, Homo sapiens
  misc_feature: GYAE6OF01ET8U4.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtgggacaacagactacgctcgcccccgtgaaaggcagattcaccatctcgagagatgaataccaaaaaccaccctgtatctgcacatagaacagcctgaacaaccgaggacacagccgtctattactgtgtcatagatgtatttacttgactaccgagtacggtacgtaagtttcggtacggtaccctttgaaccgttacggtcggggacccgtaacgggtaaccccttcgggtaccgtacccggttcctacccgtctacgtccctacccgaacccgtaacggggtcccctacggtttccccgggttacccctttccccccgtacgggtccccgtcccccgttacggtccccgttacccggaacgggtacccggtacccgtaacccccggttacccggaacggtaaccggacccgtaaccgggaaccgggccccggggttaccccggtacgggggtcccgtttcccggggtaccccggtttacggggtaaccccggttaaaccgggttaaccctttaaccccgtttaccccgttaaccgtttaccccgttaaacccgtaacccggtttaacccgttacggggtaaaccccgggtcccggggggttaccggttaaaccggggaccccggtaaaacgggggtccctaaccggtaaggttaaccggg

SEQ ID NO: 168142 - DNA, 636 bp, Homo sapiens
  misc_feature: GYAE6OF01E03SU.37.10.A10.1.454.CMB.1.raw
  modified_base (310)..(310): a, c, t, g, unknown or other
  misc_feature (310)..(310): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctgggagtgggtcggccgtagtaaaagcgaaggttctggtgggacaacagactacgctcgccccccgtagaaaggcagattcaccatctcgagagatgaaataccaaaaacccaccctgtatctgcacatagaacacgcctagaaccaaccgagacacacgccgtctattactgtntcatagatgtatttactttagactaccgaggtacggtaacgtagtttcggtaccgggtacccctttagaccgtacggtcggggacccgacgggtaaccctcggtcctacccgttcctcctaccgacgtcccctacccgaacccgaacgggccccctacggtcccgttacccccttccccccgtcggcccgtcccgtcgtccctcccgaggcgccctacccgccgagcaccacgcggccggtcccgtgggcctcggtcgtcggtacgaacgtcctacctctactctaccactacgtgacggtcggacgcggacgaaggccgagagtg

SEQ ID NO: 168143 - DNA, 582 bp, Homo sapiens
  misc_feature: GYAE6OF01A6Z7L.37.10.A10.1.454.CMB.1.raw
  modified_base (577)..(577): a, c, t, g, unknown or other
  misc_feature (577)..(577): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacacgccgtctattactgtgtcatagatgtatttactttgataccgagtcggtacgtaatttggtcggtaccctttgacctacgtcggggccacgggaccctggtcaccgtctcctcacgcctccaaccgacgggccctacgtccggtccttcccccgtggcccgccctcgcctccgacgacgccaccgtccgagcgccacgacgccggcccgtcgggcctcgccgttcggacaacggtccttaccttaccacttacctacacttacgcggtacgcgggaccgtcggacgaaggccagngtacg

SEQ ID NO: 168144 - DNA, 742 bp, Homo sapiens
  misc_feature: GYAE6OF01EKBUF.37.10.A10.1.454.CMB.1.raw
  modified_base (160)..(160): a, c, t, g, unknown or other
  misc_feature (160)..(160): n is a, c, g, or t
  modified_base (734)..(734): a, c, t, g, unknown or other
  misc_feature (734)..(734): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagngaaggttctggtggacaacagactacgctcgcccccgtagaaaggcagattcaccatctcgagagatagaactaccaaaaacccacctagtatctgcacatacgaacacgcctagaaccaaacccggaaggaaccacgacgtccgtacttaacttacgttgtagtaccaatagtattaggtaattttactttagtaactaaccgtaggtacggttaacgtaacgttttcggtaccgggtacccctttagaccgttaacggtcggggacccgtaacgggtaaccccgttcggtaccgtacccgttcctcccgtccgacccgtccctaccccgaaccggaaccggtacccctaccgttccgggttccccttccccccggtcggccctcccgtccgtacctacccgtaaggaccgtccgacccgtccgacgcgacccgacgaccgggtcccggccccggtcgggtccgtccggtccgtcggtaacccgaaccggtaccgttaccttacccgacttaccctaaccgtaccgttacgtcggaccgggccgggtacggtaccgaaccgggtacggaccgngtaactcg

SEQ ID NO: 168145 - DNA, 730 bp, Homo sapiens
  misc_feature: GYAE6OF01EST0C.37.10.A10.1.454.CMB.1.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtgggacaacagactacgctgccccgtgaaaggcagattcaccatctcgagagatgaatcaaaaaaccnccctgtactctgcacatgaacagcctagacaaccgagacacagccgtctattacctgtgtcatagatgatttactttnactaccagcgtactagtttcgtcggtaccctttgaccttacgtcggggaccacggggaaccccttggtacccgtaaccgtccctcctaccaccgaccccttccaacccgaaaccgggcccctaacgttccccgggttccccgttttaccccccgtcgggtacctcccccgttagaccccttccccggagggtacccgacccgtaaccccgttacccgaacggtaaccgacccgaaccgtaaccgggccccggtcccccgtaggggtcccgtacggttccccgttaagggtacccggaaacggttaaccgttaccccgttaccctaaccttacccgtaaccgttacctttacggccggttaacggccccgggggttactcgggaacccgtaacgggcccgtagttaacgaccgg

SEQ ID NO: 168146 - DNA, 674 bp, Homo sapiens
  misc_feature: GYAE6OF01B654V.37.10.A10.1.454.CMB.1.raw
  modified_base (245)..(245): a, c, t, g, unknown or other
  misc_feature (245)..(245): n is a, c, g, or t
  modified_base (410)..(410): a, c, t, g, unknown or other
  misc_feature (410)..(410): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctcgcccccgtgaaaggcagattcaccatctcgagagatagaactacaaaaacccncctgtatctgcacatacgaacacgcctacgaacaaccgaggaccacacgcctcgtatactcgtgtcatagtatgtattacttagtactacgagtacggtacgtatttacggtcgtaccgttgtacgtacgtacgggacgacggtacccgtcgtcacccgtctccncacgtccctaccgaccgaaccggccctaccgttccgtacccgttcccccgcggtcccgtcccgtcgtacccgtaccgacgggtacgcccgaacccgtccggaacgaccgaccgacggaccgcccggtacccggtggtacccgttcgtaccgtacggtacgtaaccgtacccgttacctaccgttacctaccgttacctaaccgttacggtacggtacccgggaccgggtccgtacgggtaccggaaggtcccggtaatagtacg

SEQ ID NO: 168147 - DNA, 736 bp, Homo sapiens
  misc_feature: GYAE6OF01E08QK.37.10.A10.1.454.CMB.1.raw
  modified_base (76)..(76): a, c, t, g, unknown or other
  misc_feature (76)..(76): n is a, c, g, or t
  modified_base (136)..(136): a, c, t, g, unknown or other
  misc_feature (136)..(136): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
tcagtagtgtagatcacgaccggtgctcgatttagcgtcgatctcaggggtcccttacactctcctgtgcagcctntggattcagtttctataccgcctggatgagctggatccgccagctccaggaagggctggngtgggtcgcgtagtaaaagcgtaaggtctggtagggacaacgagactacgctcgccccgtagaaggcagtacttcaccatcgtacgagagatagaacgtaacaaaacccncctanatctcgacatagtacaacngcctagaaccgaaccgagaccaacacgtccggtacttattacgngttacgtacatagattagtatttacgtgtaacacgtaagcggtaatacgttggtaccgtcctagactacggtcgggacctacggaaccgttcaccctccgtcctccgtacgaccggccctacccgaaccggtacccggacccgtaaccgttcggtaacccccttccccggtacccggtacccgtacccgtccgttaccggcccgtaacggaccgtaccgacccgttcgaacgtcgaaccgtaccgcgaccccgggtaccgccggtcgtaccggtaggttacccggtaaaccgaacggtacctttaaccgttaaccccgtacgttaaacccgtaaacgttacccgggttaaccgtacgggaacgggtccccggggtaagtacgggtaaccccgggaacggtcggtaaccggtaaagtacccgg

SEQ ID NO: 168148 - DNA, 567 bp, Homo sapiens
  misc_feature: GYAE6OF01A2MVC.37.10.A10.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (532)..(532): a, c, t, g, unknown or other
  misc_feature (532)..(532): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaacccaccctgtatctgcacatgaacagcctgaccaaccgagacacagccgtctattactgtgtcatagatgtattactttgataccagcggtactagtttgtacggtaccctttgacctacgtggggccaacgggtaccctggtccaccgtctcctcacgcctccaccgacggcccactccggtccttcccccgnggtccnccgtcgcctccgaggcgccaccgtccgagacgccacgcggccggcccgtgggcctcgccgttggacaacggtctacctcctatcctactactcncggacggcgggtctcgggacaagggtcacgtatag

SEQ ID NO: 168149 - DNA, 816 bp, Homo sapiens
  misc_feature: GYAE6OF01D330A.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccgagggaagggctggaggtgggtcggaccgtagtaaaagcgaaggttcgtggtggaacaacagactacgcctcgacccccgtagaaaggcagtacttaccaccattccgtacgagagatacggaaactaaccaaaaaccctccctgtactctacgtacaacagtacgaaacgcggtacctacgaacccgaaccggacggtaacaacgaccgtaccgttacttacttaccgttggtagtacaagttaagtattacggttaacttttacttacgtaacgtaaccgtacggtaacgggttaaccgttaggtttcggtacccgggttacctttacggacgtacggtcggggtaccgaaccgggtaacccgtcggtacctaaccggtccctccgtacgaccgtacccgtaacccgacggtaacccgggtcccttacgttacccggtttccccgttaccccggtaccgggtccctccccggtctaccccggtaaccgaaccggggtccctacccggtaacccgtacccgggagtaacccgacctaaccgggtaccggggtccccggtcccgggtacggtccgttcccggtaccggtttacggaaacccgttaccgtaacccgtttaaccgtcctaaccggttactaaccgtacgacggttaggacgggtccgtaggaccgaagtaacggcacgtgtacg

SEQ ID NO: 168150 - DNA, 651 bp, Homo sapiens
  misc_feature: GYAE6OF01BB22P.37.10.A10.1.454.CMB.1.raw
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (503)..(503): a, c, t, g, unknown or other
  misc_feature (503)..(503): n is a, c, g, or t
  modified_base (646)..(646): a, c, t, g, unknown or other
  misc_feature (646)..(646): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccgaggaaggggctggagtgggtcggcgtagtaaagcgaaggttctggtggacaacagactacgctcgccccgtgaagcagattcaccatctcgagagatagaataccaaaaacccnccctgtatctgcacatgaacngacctagaaccaaccgagacacacgaccgtntattacgtgtcgtacatagattggtatttacgtttcgactaccgaggtaccggttacgtaagtttcggtacggtacccctttagaccgttacggtacggggaccgtacgggtaccctcggtaccgaccgtctcctacctacgccctacccgaccgtaaccggccctacgttccgtcccttccccgtcggccgtcccgtcgcctccgacggcncccaacccgtcgaacgcgaccacgacggcccggtaccgtcgggtacctccggtccgtacgtaccgaacggtaccgttaccttccgaacttacccgttacgaccttcggacggacggcccggtcgtacggaccgacggccgtanagtcg

SEQ ID NO: 168151 - DNA, 711 bp, Homo sapiens
  misc_feature: GYAE6OF01EOZWB.37.10.A10.1.454.CMB.1.raw
  modified_base (258)..(258): a, c, t, g, unknown or other
  misc_feature (258)..(258): n is a, c, g, or t
  modified_base (708)..(708): a, c, t, g, unknown or other
  misc_feature (708)..(708): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaagggctggaggtgggtcggccgtagtaaaagcgaaggttcgtggtagggacaacagactacgctcgccccgtagaaaggcagattcaccatctacgagagatagaactaccaaaaaccaccctgtactcncgtacacatcgaacagcctacgaacgaaccgacggacacgacgtccgtacttagttaccttgtgtactatacggtatagttactttacttgaactaccgagtacggttaacgttaatttcgggtaccggtacccctttagaacgttacggtcggggacccgagggtaacccgtcggtacctcccgttacctaccgtccgacgtacccgtaccctaaccgaccggacccgtaaccgtcccggttaccccgttccccgtacccgtcccggtacccctccgtaacccgtaaccgacgtaccgtccgtaccggtccgggacgaccgacggccggtcccgtacggcgtcgtccgtcggtacgtaaccggtaccttaccgtactacctaccgtacccgtacgtaccggtaggaccgggtcggtacccgtaggaccggacggtacccgataccgagntac

SEQ ID NO: 168152 - DNA, 820 bp, Homo sapiens
  misc_feature: GYAE6OF01ARQFE.37.10.A10.1.454.CMB.1.raw
  modified_base (694)..(694): a, c, t, g, unknown or other
  misc_feature (694)..(694): n is a, c, g, or t
  modified_base (755)..(755): a, c, t, g, unknown or other
  misc_feature (755)..(755): n is a, c, g, or t
tcagtagtgtagatcacgaccggtgctcgatttagcgtcgatctcaggggtcccttacactctcctgtgcagcctctggattcagtttctataccgcctggatgagcgtggactccgccagggcctaccgaagggaaaggggctgggaggtggggtccggacgtaaggtaaaagcggtaaggtttcgtgggtacgggaacaacacggtactacgctccggaccccgtaggaaacggcaagtacttaccaacctatccgtacggagagtagtagaaactaaaccaaaaaccctccctagtactactgacaactatacgaactcgtcaacggaaccgaacgagaccacgacggtacctattaacttcgcggtatactaatagtacttagttacttttaacgttacaacgtacccggtaaggttacggttaacgtttaagtttccgggtaacccggtttacccgtttacgtaaccggttacgggttcccggggaaccgttaacccggggtacccgttcggttacccgtacccgttccttaccgaccgtaacccgtcccgtaacccggaaacccgtacccgggtcccttaaccgtttccccgggttcccctccccgggtccgtaccccgttcccgtccgacccgtaccggtacgggaccctaccccggtaccgtaccgacggacccggtaaccgaccnccggggtcccgggtccgtacggtccgtccgcgttacggacgtaaccgtactccctaccgtntaccggtacctaggtaccggtacggccgggttaccgacgggaccgtaacacgggtcaagtggtcg

SEQ ID NO: 168153 - DNA, 765 bp, Homo sapiens
  misc_feature: GYAE6OF01DK1DP.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccagggaaagggctggagtgggtcggccgtagtaaaagcgaaggttctggtgggacaacagactacgctcgccccgtgaaaggcagattcaccatctcgagagatgaaactacaaaaaccaccctgtactctagcacatagaacacgcctacgaaccaaccggaggaccacacgtccgtactattactgttgtactatagtatagtactttactttgacttaccgaggtacggttacgtaagtttcggtacggtaacccctttgaaccgttacggtacggggaccccgaagggtaaccccgttacggtcccgacccgttccgtaccctcgacgtaccctaccgaaccgaacgggtccctacgttcccggttccccgttcccccgtcggtcccgtaccccgttcggccccgttaccggaacggtaccgaccctacccggttaccggaacgtacgacccgacgaccggtacccggggtccccggttcggggtcccgtcggtcccggttacggggtacccgtaaaccggttaccctttaccgttaccctacgttaacccttaacccgtaacgttaccggtacggggaccgggtccgggggaccgttaccggggaaccgtaaccggggtaccgtaacgtaagtacgg

SEQ ID NO: 168154 - DNA, 730 bp, Homo sapiens
  misc_feature: GYAE6OF01AXV7T.37.10.A10.1.454.CMB.1.raw
  modified_base (241)..(241): a, c, t, g, unknown or other
  misc_feature (241)..(241): n is a, c, g, or t
  modified_base (726)..(726): a, c, t, g, unknown or other
  misc_feature (726)..(726): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccnccctgtatctgcacatgaacagcctagacaaccgaggacacgagtccgtactaattactggtgttacatagtatggtaattttactttagaacttaccgaggtaccggttaacgtaagttttcggtacgggttaccccttttggaaccttacggtcggggaccctaaggggtaaccccgtgggttaccaacccgttcgtcccgtacgaccgtccctacccgaacccgaacgggtcccctaacggttcccggttaccccgttcccccggtccggtcccgtcccccgttacgcccgttacccggacggtaccgtaccctacccggtaccggacgacgtacccgaacgcggaccccgggtcccgtgggtccgtacggtcccgtacggtacggaaccgtacctaccgttacctaacgttacctaaccgtaccgttaacgttcgggaccgggtaccgggtcgtacgggaccgtaaggtccgaacggttanacgg

SEQ ID NO: 168155 - DNA, 764 bp, Homo sapiens
  misc_feature: GYAE6OF01B3ZTW.37.10.A10.1.454.CMB.1.raw
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
tcagtagtgtagatcacgaccggtgctcgatttagcgtcgatctcaggggtcccttacactctcctgtgcagcctctggattcagtttctataccgcctggatgagctggatccgccagctccagggaagggctggagtgggtcggcgtaagtaaagcgaaggttcgtggtgggacaacagactacgctcgccccgtagaaaggcagtattcaccatctacgagagagtanaactaaccaaaaaccacccttagtactctacgacacaagtacgaacncgaccgtacgaaccgaaccgacggaccacgacgaccgttacttaacttaccgtggtacttaccgaagttacgagttgttaacgttttactttacgtaactaccgtaacggtacggttaacgttaaggtttacggttaccggttaccgtttaggaccgttacggtacggggaaccgtacggtaacccgttcggtaccaccgttcctcctacgacctaccctccgaacccgacggtccctaccgttcccgttccccgttccccgtacggtcccctccgtcggtacccgaccgtacgggcctaacccgacccgttaccggaacgtacgacccgtacggcccggtccgggtacccggtcgggtaccgtcgtaacccgggtacggtacgtaaacccggttccttaacccgtcctaagtacccgttacgtaacccgttcgtaacgggcccgggttaacgggacctacgggacgaaaccggctacgggctagg

SEQ ID NO: 168156 - DNA, 686 bp, Homo sapiens
  misc_feature: GYAE6OF01A6N91.37.10.A10.1.454.CMB.1.raw
  modified_base (179)..(179): a, c, t, g, unknown or other
  misc_feature (179)..(179): n is a, c, g, or t
  modified_base (239)..(239): a, c, t, g, unknown or other
  misc_feature (239)..(239): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (480)..(480): a, c, t, g, unknown or other
  misc_feature (480)..(480): n is a, c, g, or t
tcagtagtgtagatcacgaccggtgctcgatttagcgtcgatctcaggggtcccttacactctcctgtgcagcctctggattcagtttctataccgcctggatcgagctggatccgccaggctccaggaaaggggctggagtgggtcggccgtagtaaaagcgaaggttctggtggganaacagactacgctgccccgtgaaagcagattcaccatctcgagagatgaatcaaaaaccncctgtatctgcacatgacagcctgacacgagacacagcgtctattacngtntcatagatgtattactttgacttaccaggtacgtacgtaatttggtacgggtaccccttttagaaccttaaccggttgggggaacccaacggggtaaccccttgggtaccacccgggttcctcccgtacacgtccctcccgaaccgaacgggtcccaacgttccggtaccctttccccccgagggtcccncccgtagtcccgtaccgaacggcgtaccgacccgtccgaagtcctactaaccgcgacccggtcccggtcgggtcctcggaccgttcggtacgaaacggttacccgtactttacccgacgttaccgtaccttaacccggtaccgttacggaaccggggcccggggtcgtaacggggtaccctaaagggccggtaacaccggttaagg

SEQ ID NO: 168157 - DNA, 790 bp, Homo sapiens
  misc_feature: GYAE6OF01AEM0S.37.10.A10.1.454.CMB.1.raw
tcagtagtgtagatcacgaccggtgctcgatttagcgtcgatctcaggggtcccttacactctcctgtgcagcctctggattctagtttctataccgcctggatgagctggatccgccaggctccaggaaaggggctggagtgggtcggccgtaagtaaaagcgaaggttctggtggacaacagactacgctcgccccgtgaaaggcagattcaccatctcgagagatgaataccaaaaacccaccctgtatctgacacatagaacacgcctagaaccaaccgagacacagcctctattactgtgtacagtagatgtatttatttgaactaccgaggtacggtacgtaagttttcggtaccgggttacccctttgaccgttacggtcggggacccgtaacggggtaccccgttgggtaccctacccgttcctaccctaccgaccgtacccgttaccccaacccggtaacccgggacccccgtacgttccccgggttaccccctttcccccccggtcgggtcccccgtccccgtccggtacccctacccgggtaaccgggacccgtacccccgtaccccgtcccggaacggacccgacccgaacccgacccggggccccgggtaccccggttccggggcccgttaccgggtacccgttaccgggtaaccgtaaacccggttacccttacccgttaccctaacgttcccgttaaaccctaccgttaaccggtacgggaccgggtcccgggacccggttacgggaaccggaaccgggtccggacgaaggtacg

SEQ ID NO: 168158 - DNA, 523 bp, Homo sapiens
  misc_feature: GYAE6OF02JBRHG.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcggtacgaatttgtgggacccctttgactactggggccagggaaccctggtcaccgtctcctcagcctcaccaacgggcccatcggtcttcccctggccgccctgcctccaggacgcacctccgagacgcacagccggccctgggctgcctggtcaaggctacttcatctacactactgagcggctggcaaggcgcatacg

SEQ ID NO: 168159 - DNA, 620 bp, Homo sapiens
  misc_feature: GYAE6OF02HZ58R.37.10.A10.1.454.CMB.1.raw
  modified_base (466)..(466): a, c, t, g, unknown or other
  misc_feature (466)..(466): n is a, c, g, or t
tcagtagtgtagatcacgaccggtgctcgatttagcgtcgatctcaggggtcccttacactctcctcgtcgctacgcctctggattctagtttctataccgcctggatgagctggatccgccaggctccagggaaaggggtctggagtgggtcggccggttagtaaaagcgaaggttcttaggtggacaacagactacgctgcccccgtgaaaggcagattcgaccatctcgagagagtcgaatcaaaaaccaccctgtatctgcacatgaacagcctgacaaccgaggacacagccgtctattactgtgtcatagagtgatttactttgattaccagcggtacgaatttggacggaccctttgactacgtgggaccagggtaaccctggtaccaccgtactcctcacgcctccaaccgaaggcccatccgtccttcccccgtggccgccctcgctaccgaggacnccaccgtccgagacgcacgacgccggcccgtagggcctcgccgtcggtacgaaacggtaccttaccgttacctacgttaccgttaacgtaccgttaacgtacggaacggtccgggtacgttacgggaccgaacggggtccgacggtaagtacgg

SEQ ID NO: 168160 - DNA, 551 bp, Homo sapiens
  misc_feature: GYAE6OF02IR3O4.37.10.A10.1.454.CMB.1.raw
  modified_base (550)..(550): a, c, t, g, unknown or other
  misc_feature (550)..(550): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcgtacgaatttgtggacccctttgactactgggccagggaaccctggtcaccgtctcctcagcctccaccaacggcccagtccgtccttccccctggccaccctcctccgaacgacgcctacctcgtcggggcacgacggccgcccgtgggcctgccctggtcaaggacctaccttccactctacaccgtactagacggtccgggctgggacaacggccgacgatagnc

SEQ ID NO: 168161 - DNA, 604 bp, Homo sapiens
  misc_feature: GYAE6OF02JL9X5.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcgtacgtaatttgtggtaccctttgactacgtgggcagggaacctggtcaccgtctcctcacgcctccaccgaacgggcccatccggtccttcccccgtggccgccctgcctccgaggacgccacccgtccgacgacgccacgacgccggcccgtgggcctcggcccgtggtaccgaaacgggtaccttacccgttccgacgttccctaaaccgtaaccgttaccgttacggaacggtcccggggtaccttcgggaccgaagggtcccgacgtaacgtacgg

SEQ ID NO: 168162 - DNA, 530 bp, Homo sapiens
  misc_feature: GYAE6OF02IN23K.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaaccaccctgtatctgcacatgaacagcctgacaaccgaggacacagccgtctattactgtgtcatagatgattactttgataccagcgtacgaatttgtggaccctttgactacgtgggccaggaaccctggtcaccgtctcctcagccctccaccaagggccccatccggtccttcccctggccgccctgcctccgaggacgccaccctccgagacgcacagccggcctgggctcgcctggacaaggactacttccatcctacactactgacgcggctggcaggcgcatacg

SEQ ID NO: 168163 - DNA, 557 bp, Homo sapiens
  misc_feature: GYAE6OF02G2XJ0.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggtagattcaccatctcgagagatgaatcaaaaaccaccctgtatctgcacatgaacagcctgacaaccgaggacacagccgtctattactgtgtcatagatgattactttgataccagcgtacgaatttgtggaccccttgactactggggccagggaaccctggtcaccgtctcctcagcctccaccaacgggcccatccggtccttcccccgtggccgccctgcctccgaggacgccaccctccgagacgccacacgccgggccctggggccttcggcccgtgggtaccaaaggaccttaccttcccattcctacactaccgtgaacgcgggctggcaaggccgcagtagc

SEQ ID NO: 168164 - DNA, 537 bp, Homo sapiens
  misc_feature: GYAE6OF02G8D8R.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcggtacgaatttgtgggacccctttgactactggggccagggaaccctggtcaccgtctcctcagcctccaccaagggcccatccggtccttccccctggccgccctcgcctcccaggacgccaccctccgagacgcacacgccggccctgggctcgccctggtccaaggactacttccatcctacactactgacgcggctcggcaggcgcatcg

SEQ ID NO: 168165 - DNA, 590 bp, Homo sapiens
  misc_feature: GYAE6OF02HO39Y.37.10.A10.1.454.CMB.1.raw
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagtagtgtagatcacgaccggtgctcgatttagcgtcgatctcaggggtcccttacactctcctgtgcacgcctcctggatttcagtttcttataccgtcctggatgagctggatccgccaggctccaggaaaggggctggtaggtgggtcggccgtagtaaaagcgtaaggttctggtgggactaaacagactacgctgcccccgtgaaaggcagattcaccatcgtcgagagatgaactcgaaaaaccaccctgtatctgcacatgaacacgcctgactaaccgacggtacaacagccgtctattactgtgtcatagatgagttacgttgataccagcgtacgaagtttgtgggtaccctttgactacgtgggccagggaaccctggtcaccgtctcctcagccgtccaccaacggccctactccggtccttccccgtggcctccctgacctccgaggtacncacctccgagtacncgacacgccgccgngggcctcgccgtacggtaccaacggtaccttaccttcctattccgtaacacgttacgtcggacgcggcgttacggccgaacggccgacgtagtacg

SEQ ID NO: 168166 - DNA, 487 bp, Homo sapiens
  misc_feature: GYAE6OF02GUT3S.37.10.A10.1.454.CMB.1.raw
  modified_base (372)..(372): a, c, t, g, unknown or other
  misc_feature (372)..(372): n is a, c, g, or t
  modified_base (475)..(487): a, c, t, g, unknown or other
  misc_feature (475)..(487): n is a, c, g, or t
tcagtagtgtagatcacgaccggtgctcgatttagcgtcgatctcaggggtcccttacactctcctgtgcagcctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtctcccctggcnccctgcctccaggcgcacctccgacgagcacagcggccctgggctcgcctggtcaaggactactccatctacactactgagcgggctggcaaggcgcatagcnnnnnnnnnnnnn

SEQ ID NO: 168167 - DNA, 569 bp, Homo sapiens
  misc_feature: GYAE6OF02IE13R.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaaccaccctgtatctgcacatgaacagcctgacaaccgagacacagccgtctattactgtgtcatagatgattactttgataccagcggtacatttgtcgggaccctttgactacgtgggccagggaaccctggtcaccgtctcctcacgccctaccaccgaacgggcccagtccggtccttcccccgtggccgcccgtcgcctccgacggacgccacccgtccgagacgcacgacggccggcccgtgggcctcggcccttgggtacaacggtaccttactccactcctaactacctactggacgcgggtctcgggacgaacgggcacgatag

SEQ ID NO: 168168 - DNA, 578 bp, Homo sapiens
  misc_feature: GYAE6OF02HW25L.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgatttacttgataccagcgtacgaatttgtcgggtaccctttgactacgtgggcaggaaccctggtcaccgtctcctcacgcctccaccgaacgggcccagtccggttccttccccccgtggtcccgccctcgcctcccgaggacgccgacctccgagacgccacgacggccggcccgtgggccgtcgcccttcgggcaaacggtacctaccttacccgattccgtaactacctaccgtgaacgccgggctcggaccaagggccacgatacgg

SEQ ID NO: 168169 - DNA, 588 bp, Homo sapiens
  misc_feature: GYAE6OF02I2TQI.37.10.A10.1.454.CMB.1.raw
  modified_base (432)..(432): a, c, t, g, unknown or other
  misc_feature (432)..(432): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaaccacctgtatctgcacatgaacagcctgacaaccgaggacacagccgtctattactgtgtcatagatgattactttgataccagcggtacgaatttggtcgggacccctttgactacgtggggccagggaccctggtccaccgtctcctcacgcctcccaccgaacggccccatccggtccttccccctggccncccgtgcctccgaggcgccacccgtccgacgacgccacgacggccggccccgtggggcctcggcccgttgggtaccgaaacgggtaccttaaccttcccattacctaactaacctactcggacgtccgggcgtcggacgaacgggccgacagtacg

SEQ ID NO: 168170 - DNA, 586 bp, Homo sapiens
  misc_feature: GYAE6OF02GO9YM.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctcgcccccgtgaaaggcagattcaccatctcgagagatgaatacaaaaaccaccctgtatctgcacatgaacagcctgacaaccgagacacagccgtctattactgtgtcatagatgattactttgataccagcggtactaatttgtacggtacccctttgactacgtgggaccagggaaccctggtcaccgtctcctcacgccctccaccgacgggcccagtccggtcccttccccgtcggccgccctcgcctcccgaggacgccacctccgagacgccgacacggccggcccgtgggcctcgccgtcggtaccgaacggtacctaccttccacttacctaacgaccttacgtcgacggccgggtacctcgggaccgaagggccgacgtagtacg

SEQ ID NO: 168171 - DNA, 536 bp, Homo sapiens
  misc_feature: GYAE6OF02JBE8K.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcggtacaatttgtgggacccctttgactactggggccagggaaccctggtcaccgtctcctcagcctccaccaacgggcccatccggtccttccccctggccgccctgcctccgaggacgccaccctccgagacgccacacgcggccctgggctgcctggtcaagctactccatcctacactacgtcgagcgggctcggacaaggcgacatacg

SEQ ID NO: 168172 - DNA, 681 bp, Homo sapiens
  misc_feature: GYAE6OF02HNAKT.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccacctgtatctgcacatgaacagcctgaaccaaccgaggaccacagccgtctattactgtgtcatagatgattactttgataccagcggtaacgaatttggtcgggacccctttgactacgtggggccagggaaccctggtcaccgtctcctcacgtccctccgaaccgaacgggcccctaagttccccgggttaccctttcccccgtgggcccgtaccccgttcggcccgttacccgaacgggtaccgcccgtacccgttaccggaacgacgaccgaccgaacggcccgggtccccgtggggtacctcggtcccgttacgggtacccaaacggggttacccttaccgtttacccgacgtttaccccgtaacgaacccttaccggtacggtaaccgggccgggttccgttacgggcgtaaaccgggtcgacctaggtaacgg

SEQ ID NO: 168173 - DNA, 546 bp, Homo sapiens
  misc_feature: GYAE6OF02FWCIK.37.10.A10.1.454.CMB.1.raw
  modified_base (444)..(444): a, c, t, g, unknown or other
  misc_feature (444)..(444): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcggtacgtaatttgtgggacccctttgactacgtgggccagggaccctggtcaccgtctcctcagcctccaccgaacgggcccatccggtccttcccccgtggccgccctgcctccaggacnccacctccgagacgcacacgccggccctgggcctcgcctggtaccaaggtacctaccttccatctacacctactgacgcgggctgggaccaaggccacatag

SEQ ID NO: 168174 - DNA, 524 bp, Homo sapiens
  misc_feature: GYAE6OF02HCRZQ.37.10.A10.1.454.CMB.1.raw
  modified_base (335)..(335): a, c, t, g, unknown or other
  misc_feature (335)..(335): n is a, c, g, or t
  modified_base (495)..(495): a, c, t, g, unknown or other
  misc_feature (495)..(495): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcgtacgaatttgnggaccctttgactactgggccagggaaccctggtcaccgtctcctcagcctcaccaaggcccatcgtccttcccccgtggccgccctgcctccgaggacgccacctccgacgacgcacagccgcccgtgggcctcgcctggcaacgctactcatcctacnctacgtgacgcggctggcaaggcacatcg

SEQ ID NO: 168175 - DNA, 607 bp, Homo sapiens
  misc_feature: GYAE6OF02GGHBS.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaaccaccctgtatctgcacatgaacagcctgacaaccgaggacacagccgtctattactgtgtcatagatgatttactttgataccagcggtacgtaatttgtcggtacccctttgactacgtggggccagggaaccctggtcaccgtctcctcacgcctccaccgaacggcccactccggtccttccccctggccgccctcgcctccgaggacgccaccgtccgagacgccacgacgcccggcccgtcgggcctcggcccgtcgggtaccgaaacgggtaccttacccgttccacttacccgttaaccacccttaacgtcggaacggtccggggtcctacgggaccgaaacgggcgtaccgagtaacgg

SEQ ID NO: 168176 - DNA, 585 bp, Homo sapiens
  misc_feature: GYAE6OF02IO7TV.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggcgtagtaaaagcgaaggttctggtggacaacagactacgctgcccccgtgaaaggcagattcaccatctcgagagatgaactacaaaaaccaccctagtaatctgcacatcgaacagcctgacaaccgagacacagccgtactattactgtcgtcatagatgatttactttgataccagtcgtacgtaatttggtcggtaccctttgacctcgtgggccagggaaccctggtcaccgtctcctcgacgtccctacacgaacgggcccctaagtccggtccttcccccgtggccgtcccgtgccgtccgaggacgccgacccgtcgagcgacacgacgccggccgtgggcctcgccgtggtaccaaggtccttacctccgacttccgaactaaccgtacgtcggacggacgggcgtcgggaccgaacggccgcgatagg

SEQ ID NO: 168177 - DNA, 611 bp, Homo sapiens
  misc_feature: GYAE6OF02IP05V.37.10.A10.1.454.CMB.1.raw
  modified_base (445)..(445): a, c, t, g, unknown or other
  misc_feature (445)..(445): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgacaaccgaggacacagccgtctattactgtgtcatagatgtattactttgataccagtcggtaacgtaatttggtcggtacccctttgactacgtgggccagggaccctggtcaccgtctcctcagcctcaccaggcccatcggtccttcccccgtggccgccctgcctccgaggacnccgaccctccgagacgccacgacgcccggcccgttggggccttcgggcccgttcgggtacccgtaaacgggtaccctttaaccgttcccgaatttacccggtaactaacccttaaccgtggaacggtccggggtccttgggaccgtaagggcccgtacgaatacgg

SEQ ID NO: 168178 - DNA, 597 bp, Homo sapiens
  misc_feature: GYAE6OF02GT1QQ.37.10.A10.1.454.CMB.1.raw
  modified_base (428)..(428): a, c, t, g, unknown or other
  misc_feature (428)..(428): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgacaaccgaggacacagccgtctattactgtgtcatagatgtattactttgatacagcggtacgaatttgtggtaccctttgactacgtgggccagggaccctggtcaccgtctcctcacgcctccaccgaacggcccagtccggtccttcccccgtggccncccgtgcctccgacggacgccacccgtccgagacgccgacgacgccggtacccgtgggcctcggcccgttacgggtaccgaaaggtacccttaccgtttcccaacttccgtaaccctacgttactggacggcgggtaccttcgggaccgtaacgggcgtaccgagtacg

SEQ ID NO: 168179 - DNA, 781 bp, Homo sapiens
  misc_feature: GYAE6OF02GEVHC.37.10.A10.1.454.CMB.1.raw
tcagtagtgtagatcacgaccggtgctcgatttagcgtcgatctctaggggttcccggttacgaactctcctgtgtcgacgcctcgtacggattcgaagtttcctagtaccgcctggacttgacgtccttcggatcccgccacggcgtccacggaaaggggcttcggacggtgggtacggtccggtagttaaaagcgaaggttcgtggtcggacgaacacgactacgtctcgcccccgtaggaaaaggcacgacttcacccagtcctcggacgagactagaattaccgtaaaaaccacccctagttacttacgtcgacgtaaccaactacgaaaccgacggcccgtacggaaccgaacccggaacggaccaaccgtacgtaccgttacttacgttacgttggtacgtactaacgtaaggacgtacgtaactttacgttacgacctaccgacgtcggttacgtagtttcggtccggtaccgtttggtacgtacggtacgggaccgtacggtacccgtcggtcctaccgtcctcctcgacgccctaccgaccgacggccctacgttccggttacccttcccgttggccgttacccgttcgtacccgtccgacggacgaccgaccgtaccggacgacgaccgtacggccggtcccggtcccgtcggtccgtcggtccgtacggtaacgaacggtaccttaccgttaccgtaacgtaccgtaaccgtaccgttacggacggtaccggtccggtaccgtacggaccggtacggtcgtacgtagtcg

SEQ ID NO: 168180 - DNA, 539 bp, Homo sapiens
  misc_feature: GYAE6OF02G4XS7.37.10.A10.1.454.CMB.1.raw
  modified_base (536)..(538): a, c, t, g, unknown or other
  misc_feature (536)..(538): n is a, c, g, or t
tcagtagtgtagatcacgaccggtgctcgatttagcgtcgatctcaggggtcccttacactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaacaacacgctgtctctgcaacttaacagcctgagagacgaggacacggccgtatattactgtgcgaaggaagggtctagcagtgcctggtactcccactactatatggactctgggcaaaggaatcgcggtcaccgtctcctcagcctccaccaagggcccagtccggtccttccccctggccacccctcctccaacgacgccacctcgtcggggcacgacgccggcccgtgggccgtcgccgtggtccaacgggacttaccgttccactctacactactcgacggcggctcggcaaggcgcgatagnnnc

SEQ ID NO: 168181 - DNA, 612 bp, Homo sapiens
  misc_feature: GYAE6OF02JB42I.37.10.A10.1.454.CMB.1.raw
  modified_base (262)..(262): a, c, t, g, unknown or other
  misc_feature (262)..(262): n is a, c, g, or t
  modified_base (432)..(432): a, c, t, g, unknown or other
  misc_feature (432)..(432): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaccaccctgtatcctgcacatgaacngcctgacaaccgaggacacagccgtctattactgtgtcatacgatgattactttgataccagcggtacgtatttggtcggtacccctttgacctacgtggggccgacgggaaccctggtcaccgtctcctccacgcctccacgacggcccatccgtccttccccgtgccnccctgccctccgacggacgcctacccgtccgacgacgccacgacggcccggtcccgtcgggaccttcggcccgttaggtaccgtaaacgggtaccttaaccgtttaccaaccgttacctaaccttaacgtaccgtagtacgggccggtacgtcgggaccggtaacggcgaccgtatacgg

SEQ ID NO: 168182 - DNA, 763 bp, Homo sapiens
  misc_feature: GYAE6OF02HPGNO.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactagctgccccgtgaaaggcagattcaccatctcgagagatgaaatacaaaaaccaccctagtaatctgcacatagaacagcctagacaaaccggacgaaccaacgacgtaccgtacttaacttacgttagttacgtacgtaagttacgtagttaagttaacttttaacgtttagtaacttaaccgacggtacggttaaacgttaagtttacgggtaccggttacccgtttacgtaccgttacggtacggggaaccgtaacgggtaacccgttcggtacccgtaaccgtcccttaccgtaccgacctacccgtacccgaaacccggtaacccggacccgttacggttaccccggtttcccccgtttccccggaccggtcccgtaccccgtcgtacccgtacccggaaggtacccgacctaaccccgtcgaaacgtcgaccgaaccgaccggacccggtcccggtaggcccgtccgtacccggtaggtaccgaaacggtacccttaaccgtacctaacttaccgaacctcgttaaccgacggacggtaccgttggaccggtacggacggaccttagatcg

SEQ ID NO: 168183 - DNA, 661 bp, Homo sapiens
  misc_feature: GYAE6OF02IZ203.37.10.A10.1.454.CMB.1.raw
  modified_base (533)..(533): a, c, t, g, unknown or other
  misc_feature (533)..(533): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtagaaaggcagattcaccatctcgagagatgaactacaaaaacctaccctgtatctcgcacatgaaacacgcctacgaacctaaaccgacggaccgacacgtcccgtacgttacttaccgtgtgtacatagagtgtatttacgtttgaactaccaggtcggtaacgtagtttcgtaccggtacccttgtaccgtacgtcgggaccgacgggaacccgtggtaccaccgtcctcccgtacgacgtccctaccaaccgacggtacccagttcccggttcccttccccgcgtccgtccctcgcctaccgaggaccgccctacccgtccggacgaaccnccacggaccgtaccggtccggtcggccgtccggccgtaccgggtacgaaccgttccttacgtcctactaccgtactaccgtacgtacggccggcggtacgcgggaaccgacggacgtacgtacgtacg

SEQ ID NO: 168184 - DNA, 587 bp, Homo sapiens
  misc_feature: GYAE6OF02FP616.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcgtagtaatttgtggtacccctttgactactgggccagggaaccctggtcaccgtctcctcacgcctccaccaacgggcccagtccggttccttcccccgtggccgtccccgtcgcctccgaggacgccacctcccgagacgccacgacgccggacccgtggggctcgccgtcggtccaaacggtaccttacctttacccgattccgtaacctaacctaccgtggtacggccgggtccgtcgggaccaagggcgtacgacgtagg

SEQ ID NO: 168185 - DNA, 563 bp, Homo sapiens
  misc_feature: GYAE6OF02FHNBV.37.10.A10.1.454.CMB.1.raw
  modified_base (337)..(337): a, c, t, g, unknown or other
  misc_feature (337)..(337): n is a, c, g, or t
  modified_base (532)..(532): a, c, t, g, unknown or other
  misc_feature (532)..(532): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgacaaccgaggacacagccgtctattactgtgtcatagatgattactttgataccagcggtacgaatttgnggtaccctttgactacgtgggccacgggaccctggtcaccgtctcctcacgcctccaccaacgggcccagtccggtccttccccgtggccgccctgccctccgacggacgccacccgtccgacgacgccacgacgccggcccgtgggcctcgtcgtggtcaacggaccttaccttaccactctaacaccttacgngacgcgggctcggaccgaaggctacgatacg

SEQ ID NO: 168186 - DNA, 574 bp, Homo sapiens
  misc_feature: GYAE6OF02GI4WK.37.10.A10.1.454.CMB.1.raw
  modified_base (287)..(287): a, c, t, g, unknown or other
  misc_feature (287)..(287): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (571)..(571): a, c, t, g, unknown or other
  misc_feature (571)..(571): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccagggaaaggggctggagtgggtcggccgtagtaaaagcgaaggttctggtgggacaacagactacgctcgcccccgtgaaaggcagattcaccatctcgagagatgaatacaaaaacccaccctgtatctgcacatgaaacagtctgacaaccgaggaaccanacgccgtctattactgtgtcatagatgattactttgataccagcgtagaatttgtggtaccctttgactcgtgggccagggaccctggtcaccgtctcctcncnccctccacgacggcccagtccgtcctccccgtcggccacccgtccctaccgaacgacgcctacccgtcgtccggggcacgacggcccggcccgtgggcctcgccgtgtaccgaacgcgtaccttcctactcctacactcgtacgcggccggcgtcggaccggtaacggccgacgagtagntcg

SEQ ID NO: 168187 - DNA, 493 bp, Homo sapiens
  misc_feature: GYAE6OF02JIPR8.37.10.A10.1.454.CMB.1.raw
  modified_base (336)..(336): a, c, t, g, unknown or other
  misc_feature (336)..(336): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaaggcagattcaccatctcgagagatgaatcaaaaaccaccctgtatctgcacatgaacagcctgacaaccgaggacacagccgtctattactgtgtcatagatgattactttgatacagcggtacgaatttgnggaccctttgactactggggcaggaccctggtcaccgtctctcagcctcacaggccancgtctccctgcncctgctccagcncactccganagcacagcgcctggctgcctgcagactactcatctacactactgagcggctcggcaaggcgcatcg

SEQ ID NO: 168188 - DNA, 674 bp, Homo sapiens
  misc_feature: GYAE6OF02HTMY8.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatagaatacaaaaaccacctagtactctgacacatgaacagcctagacaaccgaggacacagccgtactattactgtcgtcagtagatgtatttacttgactaccgagcggtacgtaatttcggacggttaccctttgactcgtcgggccgaacgggtaccctcggtcctaccgtcctcctacacgtcccacccaccgaacggccctaggttcccgtccttcccccgtggcccgtccctgccctcgacggtaccgaccacccgtacccgacgacgaccgacgtaaccggcccgggtaccccggtggggtaccgtccggacccgttcggggtaacccgtaacgggtacccttaccctttaccgtacgttacccgttaaacccgaaccgtttacgacggtacccgggccggggtacggtcgggacccgaaggggtcccaggtaacgtacgg

SEQ ID NO: 168189 - DNA, 598 bp, Homo sapiens
  misc_feature: GYAE6OF02GBTEW.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatagaatacaaaaaccaccctagtatctgcacatagaacagcctgacaaccgaggacacagccgtctattactgtgtcatagatgtatttacttgataccagcggtacgtaatttgtcgggtacccttgactacgtcgggaccgacgggtacccgtcgtcaccgtctcctcacgtccctaccaccgaacgggtccctacgtccggtacccttccccgtggcccgccctgcctccgaggaccgccacccgtccgacgcacacgacgccggcccgtgggcctcggccctggtaccgtaacggtaccttccttacccatccgtaacctaccttacgtcggaacggccgggtcacgggacgtacgggccgtagactg

SEQ ID NO: 168190 - DNA, 802 bp, Homo sapiens
  misc_feature: GYAE6OF02GADLC.37.10.A10.1.454.CMB.1.raw
tcagtagtgtagatcacgaccggtgctcgatttagcgtcgatctcagggggtcccttacactctcctgtgcagcctctggattctagtttctatacccgcctggatgagctggactcccgccgaggcccccccccccctgaagggaaaggggcgtgggaggtggggtccggaccggtaaggtaaaacgcggtaaggttcgtgggtagggaacaacgagactaccgctccgccccgtaggaaggcagtactcaccatctacgagagatagaaactaaccaaaaaccctaccctagtactccgtacgaccaacactacgaaaccacgcccttagaacctaaaccggaacggaaccacacggtcccgttacttaacgttaccgttgttacgtactagtaacggtattaggttaactttacgtttagaacttaccgtaggtaccggttaacgttaaagttttcggtaccgggttacccctttagaacccgttacgggtacggggacccgaacggggtaaccccgttgggtacccaacccggttcctcccgtccgacgtccctaccgaaccgaaccgggtccctacgttcccggttccccgttacccccgtggtcccgtcccgtcgacccgtccgacggacgaccctacccgccggaagtccggacgaacgacggacccggtcccggtacgggccgtcgccggttacggtaccgaaacggttcccttaacccgttactaccttaccgtaacctaccgtacggtcggtacgggccggtacgtacggaccgaacgggcctacgatacgg

SEQ ID NO: 168191 - DNA, 609 bp, Homo sapiens
  misc_feature: GYAE6OF02F47PY.37.10.A10.1.454.CMB.1.raw
  modified_base (390)..(390): a, c, t, g, unknown or other
  misc_feature (390)..(390): n is a, c, g, or t
  modified_base (448)..(448): a, c, t, g, unknown or other
  misc_feature (448)..(448): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaaccaccctgtatctgcacatgaacagcctgacaaccgaggacacagccgtctattactgtgtcatagatgtattactttgataccagtcggtagtaatttggacggtaccctttgactacgtgggccacgggtaccctggtccaccgtctccncacgccctccgaccgaacgggcccacgttccggtcccttccccgtgcccgccctgccnccgacggacgcctacccgtccgagaccgcaccgacggcccggtcccgtgggcctcggcccgttcggtaccgaaacggtaccttaccttccaacttaccgttaaccaaccgttacgtcggacggtccggggtactcggggaccaagggccgtacgtagtacg

SEQ ID NO: 168192 - DNA, 807 bp, Homo sapiens
  misc_feature: GYAE6OF02GQXWV.37.10.A10.1.454.CMB.1.raw
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
tcagtagtgtagatcacgaccggtgctcgatttagcgtcgatctcaggggtcccttacactctcctgtgcagcctctggattcagtttctataccgcctggatgagctggatccgccaggctctaggaaagggctggagtgggtcggccgtagtaaaagcgaaggttctggtggacaacagactacgctgcccccgtagaaagcagattcaccatctctagagatgaatacaaaaaccacctgtatctgacanatagaacancctagaacaaccgaagaacacgacgaccgtactacttaacgtgtacgtacaatacgtatacgtaatttactttcgaactaaccgacggacggttaacgtaagtttcggtacggtaacccttagtaaccgtacggttacggggacctaacgggtaacccgtacggtaccgtaccgtccttacccgtacgtaccgtacccgtaccgaaccgtaaccgggtaccctaacgttcccgggtttaccccctttcccccggtcgggtaacccccgtccccgttcgggaccccgttaaccggaacgggaccgaccccggtttaaccgacccggtaaaggaccggtaaccgacccggtaacggccccggtacccgggtaccgttccggtaccgggttacccgttaaccggtacgtaaaaacccggggtcccttttaaacccgtttacccgaaccgtttacccgttaaacccgtaaccgttaaacccggttccggaaccggtcccgggtacccgtaacgggtaccggtaaacgggacccgttaacggtagtaacg

SEQ ID NO: 168193 - DNA, 591 bp, Homo sapiens
  misc_feature: GYAE6OF02JEQS4.37.10.A10.1.454.CMB.1.raw
  modified_base (456)..(456): a, c, t, g, unknown or other
  misc_feature (456)..(456): n is a, c, g, or t
  modified_base (477)..(477): a, c, t, g, unknown or other
  misc_feature (477)..(477): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaccaccctgtatctgcacatgaacacgcctgaaccaaccgaaggacacacgccgtactattactgtgtcatagatgatttacttagataccagcgtacgtatttgtcgggtaccctttgactacgtggggccacgggaccctggtcaccgtctccctcacgccctccaccgaacgggccctacgtccgtccttccccctggcccgtccctgccctaccgnggcacctcccgtaccagtacnccacgacggccgtcccgagggcctcgccgtggacctaaggtcccttaacgtcctaactccgtaacctaactcgtacggcgccgggcgtacgggccaacggggcacggtatacgg

SEQ ID NO: 168194 - DNA, 714 bp, Homo sapiens
  misc_feature: GYAE6OF02G4IRQ.37.10.A10.1.454.CMB.1.raw
  modified_base (242)..(242): a, c, t, g, unknown or other
  misc_feature (242)..(242): n is a, c, g, or t
tcagtagtgtagatcacgaccggtgctcgatttagcgtcgatctcagggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcacatctcgagagatgaataccaaaaaccncctagtactctgacacatgaacagcctgaccaaccgaggacacgacgccgtctattactgtgtcatagatgatttacttgactaccagtcggtacgtaagtttggtacggtacccctttgaccttacgtcgggggtaccaacggggtaaccccttgggtacctaacccggttccttacccgtacgaaccgtcccttacccgaacccgtaaacgggccccctaagttcccgggttcccctttcccccggtagggcccgtccccgttggtacccgtaccgagggtacctacccgacccgttccggaacgtaccgccgaacgacggcccgggtcccgtaggggtcctcgggaccgttacggggaccgtaacgggtaccttaccgtttacccaagttacccgtaacctaaccttaccggtacggaccgggttaccgggcgttacgggacccgtaacggggccggtactacgtacgg

SEQ ID NO: 168195 - DNA, 591 bp, Homo sapiens
  misc_feature: GYAE6OF02H1074.37.10.A10.1.454.CMB.1.raw
  modified_base (476)..(476): a, c, t, g, unknown or other
  misc_feature (476)..(476): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaagtttctggtgggacaatagactacgctgcccccgtgaaaggcagattcaccatctcgagagatgaatacaaaaaccaccctagtatctgcacatgaacagcctagaacaaccgaggacacacgccgtctattactgtgtcatagatgtatttactttgactaccagcgtaacgtaatttcggtacggtaccctttgactacgtcggggaccacgggtaaccctggtccaccgtcctcctcgacgccctccaccgaacgggccctacgtcccggttcccttccccgtggcccgcccgtcgccgtcgaggtacnccacccgtcgagcgacacgcgccggcccgtaggcctcgccgttggacaacggtccttaccttccactcgtaaccacttacgcggacggccggtcgtcggacgacggcacgatacg

SEQ ID NO: 168196 - DNA, 625 bp, Homo sapiens
  misc_feature: GYAE6OF02G4VVK.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatacaaaaacccaccctgtatctgcacatgaacagcctgaccaaccgaggacacagccgtctattactgtgtcatagatgatttactttgataccagcggtacgaatttggtcgggtacccctttgactacgtcggggccacgggaccctggtcaccgtctcctcacgccctaccaccgacggccctacgtccggttcccttccccccgtgggcccgtccccgtcgcctcccgagggcgcctacccgtccgacgacgccacgcggccgggcccgtcggggcctcggtcccgtcgggtaccaaacgggtacccttaccgttcccaacttacccttaacctaccttaccgtcggaacggtccggggtacctcgggccgaacgggccgacgtagtacgg

SEQ ID NO: 168197 - DNA, 621 bp, Homo sapiens
  misc_feature: GYAE6OF02FULX1.37.10.A10.1.454.CMB.1.raw
  modified_base (289)..(289): a, c, t, g, unknown or other
  misc_feature (289)..(289): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaacccaccctgtatctgcacatgaacagcctgaccaaccgaggacacagccgtntattactgtgtcatagatgtattactttgataccagcggtacgtaagtttgtcgggtacccctttgactacgtcggggaccagggaaccctggtccaccgtcctccctcacgtccctccgaaccgtaacggccctacgttcccggttccctttcccccgtcgggcccgtaccccgtcgccctcccgaacgggcgcccaccctccgacgtcgaccacgacgccgggcccgtgggccgtcgtccgtggttaccgaacggtaccttaccttccactaccgtaacctaactaccgtacggacggccgggcgttcggaccgaacggcctacgatacg

SEQ ID NO: 168198 - DNA, 659 bp, Homo sapiens
  misc_feature: GYAE6OF02GO88O.37.10.A10.1.454.CMB.1.raw
  modified_base (319)..(319): a, c, t, g, unknown or other
  misc_feature (319)..(319): n is a, c, g, or t
  modified_base (387)..(387): a, c, t, g, unknown or other
  misc_feature (387)..(387): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaaagcgaaggttctggtgggacaacagactacgctcgcccccgtgaaaggcagattcaccatctcgagagatgaataccaaaaaccaccctgtatctgcacatgaacagcctgaccaaccgaggacacagccgtctattactgtgtcatagatgtattatttnaataccagcggtaactaagttttgtcggtacccctttgactacggtgggccgagggtaccctggtccnccgtctcctcgacgtccctaccaccgacggcccacgttccggttaccccgtttcccccgtcggcccgtcccctcgtccgtacccgacggacgccgaccccgtccgacgacgaccaacgccggaccggtccccggtcgggtccgtcggtcccgttgggtaacccgtaacggtaacccttacccttacccgtatttacccgtaaccgttaaccttaaccggtcggtaacgggccgggtcggttccgggaccgttaaccgggcggtacagtacgg

SEQ ID NO: 168199 - DNA, 649 bp, Homo sapiens
  misc_feature: GYAE6OF02I691M.37.10.A10.1.454.CMB.1.raw
  modified_base (398)..(398): a, c, t, g, unknown or other
  misc_feature (398)..(398): n is a, c, g, or t
  modified_base (469)..(469): a, c, t, g, unknown or other
  misc_feature (469)..(469): n is a, c, g, or t
tcagtagtgtagatcacgaccggtgctcgatttagcgtcgatctcaggggtcccttacactctcctgtgcagcctctggattcagttctataccgcctggatgagctggatccgccaggctccaggaaagggctggagtgggtcggccgtagtaaaagcgaaggttctaggtgggtacaacagactacgactgacccccgtgaaaggcaggattcaccatctcgagacgatagaatacaaaaacccaccctagtactcctagcaactatgaacagcctagaaccaaccgaggacacagtccgtacttatacttgtgtcatagatgtattacttgactaccagcggtataattgtcggtacccttgactcgtgggccagggacctgtcacgtctcgtcncgcctccactacggaccctagtccgtacccttccccgaggccgtacccgtggtaccctccggacgggtacnccgtacccgtaccggaacgtaccgaccaacgtaccggcccggtaccccggtcggggtacctcccggtaccgttaccggtacgtaacggtaccttaccgttacctacgttacctaaccgtaccgtaggtaccggtcgtaccgggtaccgtgggaaccgtaacgggtcgaccgtaagtacgg

SEQ ID NO: 168200 - DNA, 738 bp, Homo sapiens
  misc_feature: GYAE6OF02I7LYZ.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccagggaaagggctggagtgggtcggccgtagtaaaagcgaaggttctggtggacaacagactacgctgccccgtgaaaggcagacttcaccatcctcgagagatagaactaccaaaaaccacctagtactctgacacatacgaacacgcctagaacaaccgaggacacacgccgtctattactgtgtacagtagatgtaatttacgtttagactaccgaggtacggtaacgttaagtttcggtaccgggttaccctttagaccgttacggtcggggaccgtaacgggtacccttcggtaccgaccgttcctacccgttacgaccgtccctaccgaaccgaacgggtcccctaacggttcccgttccccgttcccccggtgggtccccgcccgttacgcccgttacccgaacgggtacctcccgtacccgttaccggaacgacgtacccgaccgaccgggtcccggtacccgttcggggaccttccgggtaccgttacgggtaaccgtaaaccggtaccctttaccgttaccgtaacgttcccgttaaccgtaccttacggtaccggacggggtacccggtcgttaccggaacggtaacggccgtacgtagtacgg

SEQ ID NO: 168201 - DNA, 577 bp, Homo sapiens
  misc_feature: GYAE6OF02JI5LL.37.10.A10.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (380)..(380): a, c, t, g, unknown or other
  misc_feature (380)..(380): n is a, c, g, or t
  modified_base (538)..(538): a, c, t, g, unknown or other
  misc_feature (538)..(538): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcgccgtagtaaaagcgaaggttctggtgggacaacagactacgctgccccgtgaaaggcagattcnccatctcgagagacttggaatcgaaaaaccaccctgtaatcctgcacatcgaactagcctgacaaccgaggacacagccgtctattacngtgtacatagactgaatttacttgataccagcgtacattgnggaccctttagactagtgggcagggacctggcacgctccngacgcctcgaccacggcccaagtccgtaccttaccccgtcggtacgtcccgtagccctaccgacggtacgccaccgtcgacgacgcacgtacgccggtacccgtgggctacggcctggtaccacggacttccgtacgtactacgttaccacgttacgngtaacgccggtcgtcggcctaacgggctaccgagtacgg

SEQ ID NO: 168202 - DNA, 630 bp, Homo sapiens
  misc_feature: GYAE6OF02JQRCZ.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaaggggctggagtgggtcggccgtagtaaagcgaaggttctggtggacaacagactacgctcgcccccgtgaaagcagattcaccatctcgagagatgaatacaaaaaccaccctagtactctagacacatagaacagcctagaaccaaccggaggaccacgacgaccgtctattactgtcgtacatacgatgtatttacttagataccgagtcgtaacgtatttacggtcgggtaccccttgaccgttacgtggggcccgtaacgggtaacccgtggtacctaccgtctacccgtcacgtccctaccaccgacggccctacgtaccggttcctaccccgtggcccgccctcgccgtccgacgacgaccaccgtccgagacacgacacggccggacccgtggcctacgcgtcggacgaacgtacttacctaccgtactacctaccgaccgttacgacggtaccggcgggtaccgtacgggaccgaacggcccgtacagtacg

SEQ ID NO: 168203 - DNA, 763 bp, Homo sapiens
  misc_feature: GYAE6OF02IMSO6.37.10.A10.1.454.CMB.1.raw
tcagtagtgtagatcacgaccggtgctcgatttagcgtcgatctcagggtcccttacactctcctgtgcagcctctggattcagtttctataccgcctggatgagctggatccgccaggctccagggaaagggctggagtgggtcggccgtaagtaaaagcgaaggttcgtggtgggacaacgagactacgctcgccccgtagaaaggcagattcaccatctacgagagtatagaaactaaccaaaaaccaccttagtactctcgacacatacgaacacgcctacgaaccgaaccggaaggaaccacgtacggtaccgttactaacgttactcgtacgttacaagttaacgtataagttaactttaccgtttagtaaccttaaccgacgggttaaccggttaacggtttaaacgttttcgggtacccggggttaccctttaacggaccgttacgggtacggggaacccgtaacggggtaacccgttcggtaccgtacccgtccttacccacggtacccgtcccgttaacccgaaccgtaaccgggtacctaaccggttcccgttcccccgtttcccccgcggtccctcccgtcgtacccgtaccggaggtaacccgtaccgtacccgtaccggagaaccgcccgaaacgtccgggacccgtccgggtcgccgtcgtaccgttcggaacctacggaccttacgcctactaccgtaactacgacgtcggaccggtggtaccgaggaccgacggtcctagtagacg

SEQ ID NO: 168204 - DNA, 678 bp, Homo sapiens
  misc_feature: GYAE6OF02FJ3K6.37.10.A10.1.454.CMB.1.raw
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaggaagggctggagtgggtcggccgtagtaaaagcgaaggttctggtgggacaacagactacgctcgcccccgtgaaaggcagattcaccatctcgagagatgaatacaaaaccaccctagtatctgcacangaacngcctagaccaacgaggacacacgccgttctattactgtagtctatacgattagtatttactttgaactacgacgtacggtaactagttttcggtacgggttacccctttgacgttacggtcgggacccgagggtaacccgtggtacctaccctcgtcctacacgtccctacccgaaccgaccggcccgtacgttcccgttacccgttcccccggtccggtccgtcccgtcgtacccgtaccgacggtaccgacccgtacccgtaccggaacgtacgaccgacggaccggtcccggtcccggtcgggccgttcgtccgttacggtaccgtaacggtaccttaccttaccgttactacccgttactaccgtacgtcggtacggtcccgggacgttcggaacgtccggtacgacgtatag

SEQ ID NO: 168205 - DNA, 804 bp, Homo sapiens
  misc_feature: GYAE6OF02FHD60.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtgggacaacagactacgctgcccccgtagaaaggcagattcaccatctcgagagatgaatacaaaaaccacctgtaatctagacacatacgaacagcctagaccaaccggaggacacagccgtactattacgtgtgtacaatagacttgtaactttactttagacttaacccgaggtaccgggttaactaaggtttttggtaccggggttaccccttttaggaaccgttacggtacggggggaacccctaacgggggtaaccccgttcgggttacccgtaccggttcccttacccgtccgaccggtaccccttacccgaaaccggaaaccgggtcccctaacggtttcccgggttacccctttcccccggtagggtaccccgtccccgttacggcccgttaaccggaacgggttaccgaccgttacccgtaccggaagtccggtaccaacgtaccggacccgggtcccgtaccgggggtccttcggtacccgttagggtacccgaaacgggttacccttaaccggtttcccaacgtttccgtaaacccgttaacttacccgggttacggaaccgggtaccggggtaccgtacggggtaccgaaccggggttccggaaccgttaggtaacccgg

SEQ ID NO: 168206 - DNA, 699 bp, Homo sapiens
  misc_feature: GYAE6OF02IHV65.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccaggaaagggctggagtgggtcggccgtagtaaaagcgaaggttctggtgggacaacagactacgctcgcccccgtgaaaggcagattcaccatctcgagagatagaactacaaaaaccacctagtatctcgcactataggaacacgaccgtcaacgaaccggaggacacgacgcccgtatacttactgtagtcatagtagtgtactttacttagaactacgaagtacgtaacgtaagtttggtaccgggttacccttagaccttacggtcgggaccgtaacgggtaccgtcggtaaccgtcccgttactcctacgacgtccctcccgaaaccgacgggacccctacgttccccgggttacccttccccggtacggcccgtcccgtcgccgtaccggaacggacctcccgacccgttacccggagaccgtaccgaccgacggccggacccggtggccgttccgcgttaccgggtacgtaaccgggttacctaccgttacccgaacttaccgtaaccgtaccttacggtaggtaccggtcgggaccgtacggacccgggtaagcgtccgtagaaccg

SEQ ID NO: 168207 - DNA, 748 bp, Homo sapiens
  misc_feature: GYAE6OF02G1XE9.37.10.A10.1.454.CMB.1.raw
  modified_base (187)..(187): a, c, t, g, unknown or other
  misc_feature (187)..(187): n is a, c, g, or t
tcagtagtgtagatcacgaccggtgctcgatttagcgtcgatctcaggggtcccttacactctcctgtgcagcctctggattcagtttctataccgcctggatgagctggatccgccaggctccaagggaaaggggctaggaggtgggtcggccgtaaggtaaaagcgaaggttcgtggtggacaanagactacgctcgaccccgtagaaaggcagactacaccatctacgagagatagaaactaacaaaaaaccacctagtactctagcaactatacgaaacacgcctacgaaacgaaaccgacggaacaacgacgtaccgttaattaacgttacgtggtacgtacaacgtagtaagttacgtaacgttttaccgtttaagaactaaccgaacgttacggttaacgttaaagtttcgggtaaccggtaccctttagaaccgttacggtacggggaccgtaacgggtaacccgtggtaaccaccgttactaccctcgaccgtccctaccgaaccggaaccggtaccctacggtttccggttaaccccttccccgtagggccctacccggtcgtaccggtacccgaagggtaccaccgtacccgtaccggaagaccgacgacgtaccggaccggtccgtcggaccgtcgaccgtcggtaacgaaacgtacttaccctcgtaccgttacgtaaccgaacgtacgtcgaaccggtcgggtacctacgggacctaacgggatacgtagtacg

SEQ ID NO: 168208 - DNA, 784 bp, Homo sapiens
  misc_feature: GYAE6OF02HPAPJ.37.10.A10.1.454.CMB.1.raw
tcagtagtgtagatcacgaccggtgctcgatttagcgtcgatctcaggggtcccttacactctcctgtgcagcctctggattcagtttctataccgcctggatgagctggatccgccaggctccgaaggaaaggggctggagtgggtcggccgtaagtaaagcgaaggttcgtggtgggaacaacagactacgctcgccccgtgaaaggcagacttcacgatcgtcgagagatagaactaccgaaaaaacctcccttaggtactacttcgacactaactagaaacacggtcctacgaacaaccggaaggaccaacacgtccgtaccttaattacgtgtacgctagtagtactagtactttacttaggaactaccgaggtacgttaacgtacgttgtaccgggttaccttgtaccttacggtacgggtacccgtaacgggtaaacccgtcggtaccgtaccgtacctaccgtccaccgtaccctaccgacccgtaacgggcccctaacggttccggttaccccgttaccccgtccggtccgtcccgtcggccgtaccggaccgggtaacgtcccggtacccgttaccggaacgtaaccgaccgaaccgccggaccccgggtcggtccgggtacgttcccggtaccgttacggggtaccttaaaacgggtacccctttaccgggttaccctaccgtttaacccgtaaccgttaccgtaaccgtaacgggtaccgggtaacccgggttcggaacggtaacccgttagggacccgttacgaaccggtg

SEQ ID NO: 168209 - DNA, 553 bp, Homo sapiens
  misc_feature: GYAE6OF02HIA5G.37.10.A10.1.454.CMB.1.raw
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (336)..(336): a, c, t, g, unknown or other
  misc_feature (336)..(336): n is a, c, g, or t
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
  modified_base (506)..(506): a, c, t, g, unknown or other
  misc_feature (506)..(506): n is a, c, g, or t
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
  modified_base (552)..(553): a, c, t, g, unknown or other
  misc_feature (552)..(553): n is a, c, g, or t
tcagtagtgtagatcacgaccggtgctcgatttagcgtcgatctcaggggtcccttacactctcctgtgcagcctctggtttcatctttagcaactacgccatgagctgggtccgccaggctccagggaagggctggagtgggtctcaggtattactggtagtggtaataccgcatactacgcagactcgtgacgggccgttcaccgtcnccagagacattccaanaatacggtctatctaggaaatgaacngcctgagngccgagaccacggccctcattactgtgcgagagatcgaagaccggagtaagtagcaggcagtctcacgacctacgnggggacccacggaaccctggtacctaccgtctcctcacgccctaccaacgaacggccacgtccgtccctccccgtgcctaccctccaccaacgcncctaccgtcggtcggacacgngtcccgcgtcggctcgcgttcgacgtaacgtctactacacttcgacctctacgnggacgtcgggcgtcggacacggtcgacctaagtggactcgnntncnn

SEQ ID NO: 168210 - DNA, 720 bp, Homo sapiens
  misc_feature: GYAE6OF02JT5H6.37.10.A10.1.454.CMB.1.raw
  modified_base (137)..(137): a, c, t, g, unknown or other
  misc_feature (137)..(137): n is a, c, g, or t
  modified_base (662)..(662): a, c, t, g, unknown or other
  misc_feature (662)..(662): n is a, c, g, or t
tcagtagtgtagatcacgaccggtgctcgatttagcgtcgatctcaggggtcccttacactctcctgtgcagcctctggattcagtttctatccgcctggatgagctggatccgccaggctccaggaacgggctggngtcgggtcggccgtaagtaaaacgcgaaggttctggtggacaacagactacgctcgccccgtagaaaggcagtacttcacattccacggagagactgaaactaacccaaaaacctaccctagttaactcgtagacaacagtaacacgacgtccgacgaccgtaaccgacggacacgtacgtccgttactacgttactcgtacgtactaacgtagtactagtttactttacgttacaccgtacgtagggtaccgttagttacggttacggtaccggttaccctttgaccgttaaccgggtcgggtaaccgtaacgggtaacccgtcggtaccgttaccgtacttaccaccgtacgtacccgtaaccgaccgtaacgggtccctacggtttccgttccccgtacccgtcgggaccgttccgacgtccgtaccggagtcccacgtacccgtaggctacgacccgagcccggttcggtacccggtacggtctcgggtcgttaccggaaccgtagttaaccttcgtaccnttaaccggcttacgtcgtcgggacgttcccgaaggtccggatccggtacacgatacgg

SEQ ID NO: 168211 - DNA, 123 bp, Homo sapiens
  misc_feature: GYAE6OF01COZ7W.2.66.F11.1.454.CMB.1.raw
  modified_base (122)..(123): a, c, t, g, unknown or other
  misc_feature (122)..(123): n is a, c, g, or t
tcagacgctcgacacacgaccggtgctcgatttagtcacgcgagaagggaagggctggccctgacgtgttctgttcccgcctcctctgtcgagcgtctgagcgggctggcaaggcgcatagnn

SEQ ID NO: 168212 - DNA, 182 bp, Homo sapiens
  misc_feature: GYAE6OF01D3GVB.2.66.F11.1.454.CMB.1.raw
  modified_base (110)..(110): a, c, t, g, unknown or other
  misc_feature (110)..(110): n is a, c, g, or t
  modified_base (126)..(126): a, c, t, g, unknown or other
  misc_feature (126)..(126): n is a, c, g, or t
  modified_base (132)..(182): a, c, t, g, unknown or other
  misc_feature (132)..(182): n is a, c, g, or t
tcagacgctcgacacacgaccggtgctcgatttagtcacgcgagaaggggaaagggggctgggccctgacgtgtttctggttcccaccctcctctgtcgagcgtctcgancgggctcggcaaggcncatagnnnnnnnnnnnnnnnnnnnnnnnnnnnnnnnnnnnnnnnnnnnnnnnnnnn

SEQ ID NO: 168213 - DNA, 162 bp, Homo sapiens
  misc_feature: GYAE6OF01DYJ8R.2.66.F11.1.454.CMB.1.raw
  modified_base (133)..(162): a, c, t, g, unknown or other
  misc_feature (133)..(162): n is a, c, g, or t
tcagacgctcgacacacgaccggtgctcgatttagtcacgcgagaaagggtaaagggggtcgtgggccctgacgtgtttctgttcccgccctcctctgtcgagcgtctgagcgggctgggcaaggcgcatagnnnnnnnnnnnnnnnnnnnnnnnnnnnnnn

SEQ ID NO: 168214 - DNA, 125 bp, Homo sapiens
  misc_feature: GYAE6OF02JWC0M.2.66.F11.1.454.CMB.1.raw
  modified_base (122)..(125): a, c, t, g, unknown or other
  misc_feature (122)..(125): n is a, c, g, or t
tcagacgctcgacacacgaccggtgctcgatttagtcacgcgagaaggaagggctggccctgacgtgtttctgttcccgcctcctctgtcgagcgtctgagcgggctggcaaggcgcatagnnnn

SEQ ID NO: 168215 - DNA, 169 bp, Homo sapiens
  misc_feature: GYAE6OF01C4YR9.49.82.H05.1.454.CMB.1.raw
  modified_base (159)..(169): a, c, t, g, unknown or other
  misc_feature (159)..(169): n is a, c, g, or t
tcagagtcgagagacacgaccggtgctcgatttagtcgagctctctcgcggcacgtaccggtgctcgatttagtcacgcgagaaggaagggctggccctgacgtgttctgttccaccctcctctctctcgactctgagcgggctggcaaggcgcatagnnnnnnnnnnn

SEQ ID NO: 168216 - DNA, 161 bp, Homo sapiens
  misc_feature: GYAE6OF01BTMYM.49.82.H05.1.454.CMB.1.raw
  modified_base (161)..(161): a, c, t, g, unknown or other
  misc_feature (161)..(161): n is a, c, g, or t
tcagagtcgagagacacgaccggtgctcgatttagtcgagctctctcgcggcacgaccggtgctcgatttagtcacgcgagaaagggaagggctggccctgacgtgtttctgttcccaccctcctctctctcgactctgagcggctggcaaggcgcatagn

SEQ ID NO: 168217 - DNA, 111 bp, Homo sapiens
  misc_feature: GYAE6OF01B8L9T.49.82.H05.1.454.CMB.1.raw
  modified_base (111)..(111): a, c, t, g, unknown or other
  misc_feature (111)..(111): n is a, c, g, or t
tcagagtcgagagacacgaccggtgctcgatttagtcgagctctctcgcggcacgaccggtgctcgatttagtcgagctctctcgactgagcggctggcaaggcgcatagn

SEQ ID NO: 168218 - DNA, 213 bp, Homo sapiens
  misc_feature: GYAE6OF01A0QHC.49.82.H05.1.454.CMB.1.raw
  modified_base (211)..(213): a, c, t, g, unknown or other
  misc_feature (211)..(213): n is a, c, g, or t
tcagagtcgagagacacgaccggtgctcgatttagtcgagctctctcgcgggcacgaccggtgctcgatttagagagagtgtggttgggtttggggaagaggaagactgacggtcccccaggagttcaggtgctgggcacagcggccctgggctgcctggtcaaggactacttcctctctcgactctgagcgggctggcaaggcgcatagnnn

SEQ ID NO: 168219 - DNA, 252 bp, Homo sapiens
  misc_feature: GYAE6OF01D2TP5.49.82.H05.1.454.CMB.1.raw
  modified_base (247)..(252): a, c, t, g, unknown or other
  misc_feature (247)..(252): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggttggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 168220 - DNA, 227 bp, Homo sapiens
  misc_feature: GYAE6OF01D6AKB.49.82.H05.1.454.CMB.1.raw
  modified_base (212)..(227): a, c, t, g, unknown or other
  misc_feature (212)..(227): n is a, c, g, or t
tcagagtcgagagacacgaccggtgctcgatttagtcgagctctctcgcgggcacgaccggtgctcgatttagagagagtgtggttgggtttggggaaggaggaagactgacggtcccccaggagttcaggtgctgggcacagcggccctgggctgcctggtcaaggactacttcctctctcgactctgagcgggctggcaaggcgcatagnnnnnnnnnnnnnnnn

SEQ ID NO: 168221 - DNA, 212 bp, Homo sapiens
  misc_feature: GYAE6OF01B4OHJ.49.82.H05.1.454.CMB.1.raw
  modified_base (211)..(212): a, c, t, g, unknown or other
  misc_feature (211)..(212): n is a, c, g, or t
tcagagtcgagagacacgaccggtgctcgatttagtcgagctctctcgcgggcacgaccggtgctcgatttagagagagtgtggttgggtttggggaagaggaagactgacggtcccccaggagttcaggtgctgggcacagcggccctgggctgcctggtcaaggactacttcctctctcgactctgagcgggctggcaaggcgcatagnn

SEQ ID NO: 168222 - DNA, 215 bp, Homo sapiens
  misc_feature: GYAE6OF01CRJUU.49.82.H05.1.454.CMB.1.raw
  modified_base (209)..(215): a, c, t, g, unknown or other
  misc_feature (209)..(215): n is a, c, g, or t
tcagagtcgagagacacgaccggtgctcgatttagtcgagctctctcgcgggcacgaccggtgctcgatttagagagagtgtgttgggtttggggaagaggaagactgacggtcccccaggagttcaggtgctgggcacagcggccctgggctgcctggtcaaggctacttcctctctcgactctgagcgggctggcaaggcgcatagnnnnnnn

SEQ ID NO: 168223 - DNA, 198 bp, Homo sapiens
  misc_feature: GYAE6OF01ANH0D.49.82.H05.1.454.CMB.1.raw
  modified_base (197)..(198): a, c, t, g, unknown or other
  misc_feature (197)..(198): n is a, c, g, or t
tcagagtcgagagacacgaccggtgctcgatttagtcgagctctctcgcgggcacgaccggtgctcgatttagtcgagctctctcgcgggcacgaccggtgccgatttagtcacgcgagaaggaaggggctggcctgacgtgtttctgttcccgcctcctctctctcgactctgagcgggctggcaaggcgcatagnn

SEQ ID NO: 168224 - DNA, 247 bp, Homo sapiens
  misc_feature: GYAE6OF01D1N55.49.82.H05.1.454.CMB.1.raw
  modified_base (246)..(247): a, c, t, g, unknown or other
  misc_feature (246)..(247): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggttggggaagaggaagactgacggtccccaggagttcaggtgctgggcacagcggccctgggctgcctggtcaaggactacttcctctctcgactctgagcgggctggcaaggcgcatagnn

SEQ ID NO: 168225 - DNA, 211 bp, Homo sapiens
  misc_feature: GYAE6OF01BYFJP.49.82.H05.1.454.CMB.1.raw
  modified_base (210)..(211): a, c, t, g, unknown or other
  misc_feature (210)..(211): n is a, c, g, or t
tcagagtcgagagacacgaccggtgctcgatttagtcgagctctctcgcgggcacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagnn

SEQ ID NO: 168226 - DNA, 210 bp, Homo sapiens
  misc_feature: GYAE6OF01BKMPY.49.82.H05.1.454.CMB.1.raw
  modified_base (210)..(210): a, c, t, g, unknown or other
  misc_feature (210)..(210): n is a, c, g, or t
tcagagtcgagagacacgaccggtgctcgatttagtcgagctctctcgcgggcacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagn

SEQ ID NO: 168227 - DNA, 193 bp, Homo sapiens
  misc_feature: GYAE6OF01DJASG.49.82.H05.1.454.CMB.1.raw
  modified_base (193)..(193): a, c, t, g, unknown or other
  misc_feature (193)..(193): n is a, c, g, or t
tcagagtcgagagacacgaccggtgctcgattagtcgagctctctcgcgggcacgaccggtgctcgatttagtcacgcgagaaagggaaaggggtgctcgatttagtcacgcgagaaaggaaggtggccctgacgtgtttctgttcccgccctcctctctctcgactctgagcgggctggcaaggcgcatagn

SEQ ID NO: 168228 - DNA, 209 bp, Homo sapiens
  misc_feature: GYAE6OF01DU7D8.49.82.H05.1.454.CMB.1.raw
  modified_base (209)..(209): a, c, t, g, unknown or other
  misc_feature (209)..(209): n is a, c, g, or t
tcagagtcgagagacacgaccggtgctcgatttagtcgagctctctcgcggcacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagn

SEQ ID NO: 168229 - DNA, 240 bp, Homo sapiens
  misc_feature: GYAE6OF01CKSOG.49.82.H05.1.454.CMB.1.raw
  modified_base (237)..(240): a, c, t, g, unknown or other
  misc_feature (237)..(240): n is a, c, g, or t
tcagagtcgagagacacgaccggtgctcgatttagtcgagctctctcgcgggcacgaccggtgctcgatttagtcgagctctctcgcggcacgaccggtgctcgatttagtcgagtctctcgcgggcacgaccggtgctcgatttagtcacgcgagaaggaaaggggctggccctgacgtgtttctgttcccaccctcctctctctcgactctgagcgggctggcaaggcgcatagnnnn

SEQ ID NO: 168230 - DNA, 195 bp, Homo sapiens
  misc_feature: GYAE6OF01EV9CS.49.82.H05.1.454.CMB.1.raw
  modified_base (194)..(195): a, c, t, g, unknown or other
  misc_feature (194)..(195): n is a, c, g, or t
tcagagtcgagagacacgaccggtgctcgatttagtcgagctctctcgcggcacgaccggtgctcgatttagtcgagctctctcgcggcacgaccggtgctcgatttagtcacgcgagaaggaagggctggcctgacgtgtttctgttccgcctcctctctctcgactctgagcgggctggcaaggcgcatagnn

SEQ ID NO: 168231 - DNA, 165 bp, Homo sapiens
  misc_feature: GYAE6OF01AIUMA.49.82.H05.1.454.CMB.1.raw
  modified_base (165)..(165): a, c, t, g, unknown or other
  misc_feature (165)..(165): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccaccctcctctctctcgactctgagcgggctggcaaggcgcatagn

SEQ ID NO: 168232 - DNA, 210 bp, Homo sapiens; identical to SEQ ID NO: 168226
  misc_feature: GYAE6OF01DFMDW.49.82.H05.1.454.CMB.1.raw
  modified_base (210)..(210): a, c, t, g, unknown or other
  misc_feature (210)..(210): n is a, c, g, or t

SEQ ID NO: 168233 - DNA, 107 bp, Homo sapiens
  misc_feature: GYAE6OF01CBSA9.49.82.H05.1.454.CMB.1.raw
  modified_base (107)..(107): a, c, t, g, unknown or other
  misc_feature (107)..(107): n is a, c, g, or t
tcagagtcgagagacacgaccggtgctcgatttagtcgagctctctcgcgggcacgaccggtgctcgatttagtcgagctctctagcgggctggcaaggcgcatagn

SEQ ID NO: 168234 - DNA, 211 bp, Homo sapiens
  misc_feature: GYAE6OF01BPM4F.49.82.H05.1.454.CMB.1.raw
  modified_base (211)..(211): a, c, t, g, unknown or other
  misc_feature (211)..(211): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagn

SEQ ID NO: 168235 - DNA, 167 bp, Homo sapiens
  misc_feature: GYAE6OF01EDI8R.49.82.H05.1.454.CMB.1.raw
  modified_base (165)..(167): a, c, t, g, unknown or other
  misc_feature (165)..(167): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccgccctcctctctctcgactctgagcgggctggcaaggcgcatagnnn

SEQ ID NO: 168236 - DNA, 171 bp, Homo sapiens
  misc_feature: GYAE6OF01CAPZX.49.82.H05.1.454.CMB.1.raw
  modified_base (171)..(171): a, c, t, g, unknown or other
  misc_feature (171)..(171): n is a, c, g, or t
tcagagtcgagagacacgaccggtgctcgatttagtcgagctctctcgcgggcacgaccggtgctcgatttagtcgagctctctcgcgggtcgagctctctcgcgggcacgaccggtgctcgaaaacaccctctctctctcgactctgagcgggctggcaaggcgcatagn

SEQ ID NO: 168237 - DNA, 163 bp, Homo sapiens
  misc_feature: GYAE6OF01DVITI.49.82.H05.1.454.CMB.1.raw
  modified_base (162)..(163): a, c, t, g, unknown or other
  misc_feature (162)..(163): n is a, c, g, or t
tcagagtcgagagacacgaccggtgctcgatttagtcgagctctctcgcgggcacgaccggtgctcgatttagtcacgcgagaagggaagggctggccctgacgtgtttctgttcccaccctcctctctctcgactctgagcgggctggcaaggcgcatagnn

SEQ ID NO: 168238 - DNA, 251 bp, Homo sapiens
  misc_feature: GYAE6OF01B0UOG.49.82.H05.1.454.CMB.1.raw
  modified_base (249)..(251): a, c, t, g, unknown or other
  misc_feature (249)..(251): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 168239 - DNA, 164 bp, Homo sapiens
  misc_feature: GYAE6OF01AWNL4.49.82.H05.1.454.CMB.1.raw
  modified_base (164)..(164): a, c, t, g, unknown or other
  misc_feature (164)..(164): n is a, c, g, or t
tcagagtcgagagacacgaccggtgctcgatttagtcgagctctctcgcgggcacgaccggtgctcgatttagtcacgcgagaaagggaaggggctggccctgacgtgtttctgttcccaccctcctctctctcgactctgagcgggctggcaaggcgcatagn

SEQ ID NO: 168240 - DNA, 212 bp, Homo sapiens
  misc_feature: GYAE6OF01ER1AD.49.82.H05.1.454.CMB.1.raw
  modified_base (212)..(212): a, c, t, g, unknown or other
  misc_feature (212)..(212): n is a, c, g, or t
tcagagtcgagagacacgaccggtgctcgatttagtcgagctctctcgcgggcacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 168241 - DNA, 212 bp, Homo sapiens
  misc_feature: GYAE6OF01EULG3.49.82.H05.1.454.CMB.1.raw
  modified_base (211)..(212): a, c, t, g, unknown or other
  misc_feature (211)..(212): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 168242 - DNA, 164 bp, Homo sapiens; identical to SEQ ID NO: 168239
  misc_feature: GYAE6OF01BUA7L.49.82.H05.1.454.CMB.1.raw
  modified_base (164)..(164): a, c, t, g, unknown or other
  misc_feature (164)..(164): n is a, c, g, or t

SEQ ID NO: 168243 - DNA, 165 bp, Homo sapiens
  misc_feature: GYAE6OF01DNOBY.49.82.H05.1.454.CMB.1.raw
  modified_base (164)..(165): a, c, t, g, unknown or other
  misc_feature (164)..(165): n is a, c, g, or t
tcagagtcgagagacacgaccggtgctcgatttagtcgagctctctcgcgggcacgaccggtgctcgatttagtcacgcgagaaagggaaagggctggccctgacgtgtttctgttcccaccctcctctctctcgactctgagcgggctggcaaggcgcatagnn

SEQ ID NO: 168244 - DNA, 214 bp, Homo sapiens
  misc_feature: GYAE6OF01EPEFP.49.82.H05.1.454.CMB.1.raw
  modified_base (212)..(214): a, c, t, g, unknown or other
  misc_feature (212)..(214): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnn

SEQ ID NO: 168245 - DNA, 166 bp, Homo sapiens
  misc_feature: GYAE6OF01DBKTL.49.82.H05.1.454.CMB.1.raw
  modified_base (165)..(166): a, c, t, g, unknown or other
  misc_feature (165)..(166): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccgccctcctctctctcgactctgagcgggctggcaaggcgcatagnn

SEQ ID NO: 168246 - DNA, 252 bp, Homo sapiens
  misc_feature: GYAE6OF01EQU5D.49.82.H05.1.454.CMB.1.raw
  modified_base (248)..(252): a, c, t, g, unknown or other
  misc_feature (248)..(252): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagnnnnn

SEQ ID NO: 168247 - DNA, 268 bp, Homo sapiens
  misc_feature: GYAE6OF01C3OPS.49.82.H05.1.454.CMB.1.raw
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (257)..(268): a, c, t, g, unknown or other
  misc_feature (257)..(268): n is a, c, g, or t
tcagagtcgagagacacgaccggtgctcgatttagtcgagctctctcgcgggcacgaccggtgctcgaatttacgtgtgagtagttccgacgggccacgaccggtgctcgatttagtgtgagtagttccgcgggcacgaccggtgctcgatttagcgagctctctcgcggggtcagctctctcgcgggcaacgaccggtgctcgaaaaaaccnccctctctctctcgactcngagcggctggacaaggcncagtagnnnnnnnnnnnn

SEQ ID NO: 168248 - DNA, 284 bp, Homo sapiens
  misc_feature: GYAE6OF01DSLSO.49.82.H05.1.454.CMB.1.raw
  modified_base (280)..(284): a, c, t, g, unknown or other
  misc_feature (280)..(284): n is a, c, g, or t
tcagagtcgagagacacgaccggtgctcgatttagtcgagctctctcgcgggcacgaccggtgctcgatttagtcgagctctctcgcggcacgaccggtgctcgatttagcgagacgcgcagggcacgaccggtgctcgatttagagagagtgtgttgggttggggaagaggagactgacggtcccccaggagttcaggtgctgggcacagcggccctgggctgcctggtcaaggactacttcctctctcgactctgagcgggctggcaaggcgcatagnnnnn

SEQ ID NO: 168249 - DNA, 143 bp, Homo sapiens
  misc_feature: GYAE6OF01C3AHS.49.82.H05.1.454.CMB.1.raw
  modified_base (119)..(119): a, c, t, g, unknown or other
  misc_feature (119)..(119): n is a, c, g, or t
  modified_base (143)..(143): a, c, t, g, unknown or other
  misc_feature (143)..(143): n is a, c, g, or t
tcagagtcgagagacacgaccggtgctcgatttagtcgagctctctcgcgggcacgaccggtgctcgatttagacgacagctcagggcacgaccggtgctcgatttggacgacagctcngagcgggctggcaaggcgcatagn

SEQ ID NO: 168250 - DNA, 114 bp, Homo sapiens
  misc_feature: GYAE6OF01EOPII.49.82.H05.1.454.CMB.1.raw
tcagagtcgagagacacgaccggtgctcgatttagtcgagctctctcgcgggcacgaccggtgctcgatttagtcgagctctctcgactctgagcgggctggcaaggcgcatag

SEQ ID NO: 168251 - DNA, 201 bp, Homo sapiens
  misc_feature: GYAE6OF01EW0K9.49.82.H05.1.454.CMB.1.raw
  modified_base (201)..(201): a, c, t, g, unknown or other
  misc_feature (201)..(201): n is a, c, g, or t
tcagagtcgagagacacgaccggtgctcgatttagtcgagctctctcgcgggcacgaccggtgctcgatttagtcgagctctctcgcgggcacgaccggtgccgatttagtcacgcgagaaagggaaggggctggccctgacgtgtttctgttcccaccctcctctctctcgactctgagcgggctggcaaggcgcatagn

SEQ ID NO: 168252 - DNA, 120 bp, Homo sapiens
  misc_feature: GYAE6OF01B2L1H.49.82.H05.1.454.CMB.1.raw
  modified_base (119)..(120): a, c, t, g, unknown or other
  misc_feature (119)..(120): n is a, c, g, or t
tcagagtcgagagacacgaccggtgctcgatttagtcgagctctctcgcgggcacgaccggtgctcgatttagtcgagctctctctctcgactctgagcgggctggcaaggcgcatagnn

SEQ ID NO: 168253 - DNA, 247 bp, Homo sapiens
  misc_feature: GYAE6OF01D5KIL.49.82.H05.1.454.CMB.1.raw
  modified_base (246)..(247): a, c, t, g, unknown or other
  misc_feature (246)..(247): n is a, c, g, or t
tcagagtcgagagacacgaccggtgctcgatttagtcgagctctctcgcggcacgaccggtgctcgatttagtcgagctctctcgcgggcacgaccggtgctcgatttagagagagtgtgttgggttggggaagaggaagactgacggtcccccaggagttcaggtgctgggcacagcggccctgggctgcctggtcaaggactacttcctctctcgactctgagcgggctggcaaggcgcatagnn

SEQ ID NO: 168254 - DNA, 557 bp, Homo sapiens
  misc_feature: GYAE6OF01AQZ0X.49.82.H05.1.454.CMB.1.raw
  modified_base (410)..(410): a, c, t, g, unknown or other
  misc_feature (410)..(410): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaacgcccccaaactcatcatttatgaggccgatcagcggccctcgaggggtctctgatcgtcttctctcggctccacgtctggcagcacggccctccctgacaatcctcgtcgggctccgaggcgtggggacgnggctgatttattattgcttgttcattatggccggtgagttaggtgggaccggtaaggggttcggttcgggacgggtaaggggaacgtaaagggtcgacccggttcgtagggtccacgcccgaaggccctccggcccccgttggtccc

SEQ ID NO: 168255 - DNA, 122 bp, Homo sapiens
  misc_feature: GYAE6OF01DM5Q1.49.82.H05.1.454.CMB.1.raw
  modified_base (119)..(122): a, c, t, g, unknown or other
  misc_feature (119)..(122): n is a, c, g, or t
tcagagtcgagagacacgaccggtgctcgatttagtcgagctctctcgcgggcacgaccggtgctcgatttagtcgagctctctctctcgactctgagcgggctggcaaggcgcatagnnnn

SEQ ID NO: 168256 - DNA, 225 bp, Homo sapiens
  misc_feature: GYAE6OF01B9QOJ.49.82.H05.1.454.CMB.1.raw
  modified_base (210)..(225): a, c, t, g, unknown or other
  misc_feature (210)..(225): n is a, c, g, or t
tcagagtcgagagacacgaccggtgctcgatttagtcgagctctctcgcgggcacgaccggtgctcgatttagtcgagctctctcgcgggcacgaccggtgctcgatttagatcgtctgtgttgggttggcagcctaaggctgcccccagcgtcactctgttcccaccctcctctctctcgactctgagcgggctggcaaggcgcatagnnnnnnnnnnnnnnnn

SEQ ID NO: 168257 - DNA, 214 bp, Homo sapiens
  misc_feature: GYAE6OF01DQQDV.49.82.H05.1.454.CMB.1.raw
  modified_base (213)..(214): a, c, t, g, unknown or other
  misc_feature (213)..(214): n is a, c, g, or t
tcagagtcgagagacacgaccggtgctcgatttagtcgagctctctcgcgggcacgaccggtgctcgatttagagagagtgtggttgggtttgggggaagaggaagactgacggtccccccaggagttcaggtgctgggcacagcggccctgggctgcctggtcaaggactacttcctctctcgactctgagcgggctggcaaggcgcatagnn

SEQ ID NO: 168258 - DNA, 200 bp, Homo sapiens
  misc_feature: GYAE6OF01CS15B.49.82.H05.1.454.CMB.1.raw
  modified_base (199)..(200): a, c, t, g, unknown or other
  misc_feature (199)..(200): n is a, c, g, or t
tcagagtcgagagacacgaccggtgctcgatttagtcgagctctctcgcgggcacgaccggtgctcgatttagctctacgctcagggcacgaccggtgctcgatttagtcacgcgagaaagggaaagggctggccctgacgtgtttctgttcccaccctcctctctctcgactctgagcgggctggcaaggcgcatagnn

SEQ ID NO: 168259 - DNA, 211 bp, Homo sapiens; identical to SEQ ID NO: 168225
  misc_feature: GYAE6OF01CG4I9.49.82.H05.1.454.CMB.1.raw
  modified_base (210)..(211): a, c, t, g, unknown or other
  misc_feature (210)..(211): n is a, c, g, or t

SEQ ID NO: 168260 - DNA, 280 bp, Homo sapiens
  misc_feature: GYAE6OF01D5T6Y.49.82.H05.1.454.CMB.1.raw
  modified_base (280)..(280): a, c, t, g, unknown or other
  misc_feature (280)..(280): n is a, c, g, or t
tcagagtcgagagacacgaccggtgctcgatttagtcgagctctctcgcgggcacgaccggtgctcgatttagtcgagctctctcggcggcacgaccggtgctcgtatttagtcgagtctctcgcgggcacgaccggtgctcgtatttagctctacgcgtcgagggcacgaccggtgcttcgatttacgtcacgcgagaaagggaaggggctggccctgacgtgtttctgttcccaccctcctctctctcgactctgagcgggctggcaaggcgcatagn

SEQ ID NO: 168261 - DNA, 505 bp, Homo sapiens
  misc_feature: GYAE6OF01EEYW4.49.82.H05.1.454.CMB.1.raw
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctggctccaggctggggacaggctgattattattgctgttcatatgccggtgatagtggccgaagggtgttcggcggagggacgaaaggtgaccgtctaggtcacgcccaaggctcgcccctggtcc

SEQ ID NO: 168262 - DNA, 212 bp, Homo sapiens
  misc_feature: GYAE6OF01DEWYM.49.82.H05.1.454.CMB.1.raw
  modified_base (212)..(212): a, c, t, g, unknown or other
  misc_feature (212)..(212): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 168263 - DNA, 214 bp, Homo sapiens
  misc_feature: GYAE6OF01DNXQ0.49.82.H05.1.454.CMB.1.raw
  modified_base (214)..(214): a, c, t, g, unknown or other
  misc_feature (214)..(214): n is a, c, g, or t
tcagagtcgagagacacgaccggtgctcgatttagtcgagctctctcgcgggcacgaccggtgctcgatttagctctacgctcagggcacgaccggtgctcgatttagatagctctcgttgggttgggcacgaccggtgctcgatttagatagccctttgtgtgttcccaccctcctctctctcgactctgagcgggctggcaaggcgcatagn

SEQ ID NO: 168264 - DNA, 211 bp, Homo sapiens
  misc_feature: GYAE6OF01D2FIV.49.82.H05.1.454.CMB.1.raw
  modified_base (211)..(211): a, c, t, g, unknown or other
  misc_feature (211)..(211): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 168265 - DNA, 212 bp, Homo sapiens; identical to SEQ ID NO: 168240
  misc_feature: GYAE6OF01DIXH0.49.82.H05.1.454.CMB.1.raw
  modified_base (212)..(212): a, c, t, g, unknown or other
  misc_feature (212)..(212): n is a, c, g, or t

SEQ ID NO: 168266 - DNA, 165 bp, Homo sapiens
  misc_feature: GYAE6OF01BQ52S.49.82.H05.1.454.CMB.1.raw
  modified_base (165)..(165): a, c, t, g, unknown or other
  misc_feature (165)..(165): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccgccctcctctctctcgactctgagcgggctggcaaggcgcatagn

SEQ ID NO: 168267 - DNA, 251 bp, Homo sapiens; identical to SEQ ID NO: 168238
  misc_feature: GYAE6OF01D2310.49.82.H05.1.454.CMB.1.raw
  modified_base (249)..(251): a, c, t, g, unknown or other
  misc_feature (249)..(251): n is a, c, g, or t

SEQ ID NO: 168268 - DNA, 251 bp, Homo sapiens
  misc_feature: GYAE6OF01DO18A.49.82.H05.1.454.CMB.1.raw
  modified_base (248)..(251): a, c, t, g, unknown or other
  misc_feature (248)..(251): n is a, c, g, or t
tcagagtcgagagacacgaccggtgctcgatttagtcgagctctctcgcgggcacgaccggtgctcgatttagtcgagctctctcggcgggcacgaccggtgctcgatttagagagagtgtgttgggttggggaagaggaagactgacggtcccccaggagttcaggtgctgggcacagcggccctgggctgcctggtcaaggactacttcctctctcgactctgagcgggctggcaaggcgcatagnnnn

SEQ ID NO: 168269 - DNA, 502 bp, Homo sapiens
  misc_feature: GYAE6OF01BRM3Y.49.82.H05.1.454.CMB.1.raw
tcagagtcgagagacacgaccggtgctcgatttagtcgagctctctcgcgggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcggccctcagggtctctgatcgcttctctggctcacgtctggcagcacggcctcctgacatctctggctccagctgggacgaggctgattattattgctgttcatatgcgtgatagtggccgaagggtgttcggcggagggaccgaaggtgaccgtccgtaggtcagcccaaggcctcgcccccgtggtcccg

SEQ ID NO: 168270 - DNA, 204 bp, Homo sapiens
  misc_feature: GYAE6OF01AI0FT.49.82.H05.1.454.CMB.1.raw
  modified_base (202)..(204): a, c, t, g, unknown or other
  misc_feature (202)..(204): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactaccgactctgagcgggctggcaaggcgcatagnnn

SEQ ID NO: 168271 - DNA, 171 bp, Homo sapiens
  misc_feature: GYAE6OF01AECWL.49.82.H05.1.454.CMB.1.raw
  modified_base (170)..(171): a, c, t, g, unknown or other
  misc_feature (170)..(171): n is a, c, g, or t
tcagagtcgagagacacgaccggtgctcgatttagtcgagctctctcgcgggcacgaccggtgctcgatttagtcgagctctctcgcggcacgaccggtgctcgatttagacgtcttcatcttccgccatctgatctctcgactctgagcgggctggcaaggcgcatagnn

SEQ ID NO: 168272 - DNA, 213 bp, Homo sapiens
  misc_feature: GYAE6OF01BPVL9.49.82.H05.1.454.CMB.1.raw
  modified_base (213)..(213): a, c, t, g, unknown or other
  misc_feature (213)..(213): n is a, c, g, or t
tcagagtcgagagacacgaccggtgctcgatttagtcgagctctctcgcgggcacgaccggtgctcgatttagagagagtgtggttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 168273 - DNA, 212 bp, Homo sapiens; identical to SEQ ID NO: 168262
  misc_feature: GYAE6OF01CKL8L.49.82.H05.1.454.CMB.1.raw
  modified_base (212)..(212): a, c, t, g, unknown or other
  misc_feature (212)..(212): n is a, c, g, or t

SEQ ID NO: 168274 - DNA, 210 bp, Homo sapiens
  misc_feature: GYAE6OF01CYMLG.49.82.H05.1.454.CMB.1.raw
  modified_base (208)..(210): a, c, t, g, unknown or other
  misc_feature (208)..(210): n is a, c, g, or t
tcagagtcgagagacacgaccggtgctcgatttagtcgagctctctcgcgggcacgaccggtgctcgatttagagagagtgtgttggtttggggaagaggaagactgacggtcccccaggagttcaggtgctgggcacagcggccctgggctgcctggtcaaggactacttcctctctcgactctgagcgggctggcaaggcgcatgnnn

SEQ ID NO: 168275 - DNA, 119 bp, Homo sapiens
  misc_feature: GYAE6OF01AWDZJ.49.82.H05.1.454.CMB.1.raw
  modified_base (119)..(119): a, c, t, g, unknown or other
  misc_feature (119)..(119): n is a, c, g, or t
tcagagtcgagagacacgaccggtgctcgatttagtcgagctctctcgcgggcacgaccggtgctcgatttagtcgagctctctctctcgactctgagcgggctggcaaggcgcatagn

SEQ ID NO: 168276 - DNA, 505 bp, Homo sapiens
  misc_feature: GYAE6OF01BXORI.49.82.H05.1.454.CMB.1.raw
  modified_base (318)..(318): a, c, t, g, unknown or other
  misc_feature (318)..(318): n is a, c, g, or t
  modified_base (492)..(492): a, c, t, g, unknown or other
  misc_feature (492)..(492): n is a, c, g, or t
tcagagtcgagagacacgaccggtgctcgatttagtcgagctctctcgcgggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctnaggggtctctgatcgcttctctggctccacgtctggcagcacggcctcctgacaatctctgggctccaggctggggacgaggctgattattattgctgttcatatgccggtgatgtggccgaagggtgttcggcggagggaccgaaggtgaccgtctaggtcagcccaaggccngcccccgtggtcc

SEQ ID NO: 168277 - DNA, 151 bp, Homo sapiens
  misc_feature: GYAE6OF01DHBC7.49.82.H05.1.454.CMB.1.raw
  modified_base (136)..(151): a, c, t, g, unknown or other
  misc_feature (136)..(151): n is a, c, g, or t
tcagagtcgagagacacgaccggtgctcgatttagtcgagctctctcgcgggcacgaccggtgctcgatttagacgtcttcatcttcccgccgatctgatctctcgtactctgagcggctcggcaaggcgcatagnnnnnnnnnnnnnnnn

SEQ ID NO: 168278 - DNA, 214 bp, Homo sapiens
  misc_feature: GYAE6OF01B4UON.49.82.H05.1.454.CMB.1.raw
  modified_base (211)..(214): a, c, t, g, unknown or other
  misc_feature (211)..(214): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 168279 - DNA, 357 bp, Homo sapiens
  misc_feature: GYAE6OF01DBM2R.49.82.H05.1.454.CMB.1.raw
  modified_base (324)..(324): a, c, t, g, unknown or other
  misc_feature (324)..(324): n is a, c, g, or t
  modified_base (346)..(357): a, c, t, g, unknown or other
  misc_feature (346)..(357): n is a, c, g, or t
tcagagtcgagagacacgaccggtgctcgatttagtcgagctctctcgcgggcacgaccggtgctcgatttagtcgagctctctcgcgggcacgaccggtgctcgactttagtcgagctctctcggcgggcacgaccggtgctcgactttagtcgagcgtctcttcggcgggacacgaccggtcgcgtcggtactttaggaggtagaggtgtgttgggttgggggaacgaggaagacctggaccggtcccccgaggagttcaaggtgctgggcacagcgcctgggctcgcctggtcaaggactacttccagtactctatctgancgggctgggcaaggcgcatagnnnnnnnnnnnn

SEQ ID NO: 168280 - DNA, 534 bp, Homo sapiens
  misc_feature: GYAE6OF01CLXP3.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataatcttttctcctggtaccaacaacacccaggcaaagcccccaaactcatcatttatgaggccgatcagcggccctcaggggtctctgatcgcttctctggctccacgtctggcagcacggcctccctgacaatctctgggctccgaggcgtggggacgaggctgattattattgcttgttcattagtgtccggtgagtaggtggaccggtaagggtgttcgggcgggacgggaccgaagggtcggacccgtccgtaggtcacggacccaaggcctcgccccccgtcggg

SEQ ID NO: 168281 - DNA, 212 bp, Homo sapiens; identical to SEQ ID NO: 168262
  misc_feature: GYAE6OF01CBJS0.49.82.H05.1.454.CMB.1.raw
  modified_base (212)..(212): a, c, t, g, unknown or other
  misc_feature (212)..(212): n is a, c, g, or t

SEQ ID NO: 168282 - DNA, 127 bp, Homo sapiens
  misc_feature: GYAE6OF01ESDX3.49.82.H05.1.454.CMB.1.raw
  modified_base (127)..(127): a, c, t, g, unknown or other
  misc_feature (127)..(127): n is a, c, g, or t
tcagagtcgagagacacgaccggtgctcgatttagtcgagctctctcgcgggcacgaccggtgctcgatttagtcgagctctctcgcgggctggcaaggcgctgagcgggctggcaaggcgcatagn

SEQ ID NO: 168283 - DNA, 514 bp, Homo sapiens
  misc_feature: GYAE6OF01D5A9P.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcgccctcagggtctctgatcgcttctctggctccacgtctggcagcacggcctccctgacaatctctggctccgaggcgtggggacgaggctgattattattgctgttcatatgcgtgatagtggccgaagggtgttcgggcggagggacgaaaggtgaccgttccgaggtcacggtacccaaggcctcgcccccgtggtccc

SEQ ID NO: 168284 - DNA, 519 bp, Homo sapiens
  misc_feature: GYAE6OF01BN4J5.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcgaggggtctctgatcgcttctctggctccacgtctggcagcacggcctccctgacaatctctgggctccaggctggggacgaggctgattattattgcttgttcatatgccggtgatagtggccgaagggtgttcggcggagggaccgaagggtgaccggtcgtaggtcacgcccgaaggcctcggcccccgtggtccc

SEQ ID NO: 168285 - DNA, 216 bp, Homo sapiens
  misc_feature: GYAE6OF01CR8OH.49.82.H05.1.454.CMB.1.raw
  modified_base (213)..(216): a, c, t, g, unknown or other
  misc_feature (213)..(216): n is a, c, g, or t
tcagagtcgagagacacgaccggtgctcgatttagtcgagctctctcgcgggcacgaccggtgctcgatttagatcgtctgtgttgggtttgggggaagaggaagactgaccggtccccccaggagttcaggtgctgggcacagcggccctgggctgcctggtcaaggactacttcctctctcgactctgagcgggctggcaaggcgcatagnnnn

SEQ ID NO: 168286 - DNA, 211 bp, Homo sapiens
  misc_feature: GYAE6OF01BTZEJ.49.82.H05.1.454.CMB.1.raw
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctggactgcctggtcaaggactacttcctctctcgactctgagcgggctggcaaggcgcatag

SEQ ID NO: 168287 - DNA, 535 bp, Homo sapiens
  misc_feature: GYAE6OF01EBD3W.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacgcctcctgacatctctgggctcaggcgtggggacgaggctgtattattattgcttgttcatatgccggtgtataggtggaccggtaagggtcggttcgggcgggaggggacgaaagggtcgacccggttccgtaggtcaacggcccaaggccctcgccccccgtggtacccg

SEQ ID NO: 168288 - DNA, 165 bp, Homo sapiens; identical to SEQ ID NO: 168231
  misc_feature: GYAE6OF01BWDAS.49.82.H05.1.454.CMB.1.raw
  modified_base (165)..(165): a, c, t, g, unknown or other
  misc_feature (165)..(165): n is a, c, g, or t

SEQ ID NO: 168289 - DNA, 509 bp, Homo sapiens
  misc_feature: GYAE6OF01C6WSN.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctcctgacaatctctgggctcaggctgggacgaggctgattattattgctgttcatatgccggtgatagtggccgaagggtgttcgggcggagggacgaaaggtgaccggtctaggtcagcccaaggcctcgccccctggtacc

SEQ ID NO: 168290 - DNA, 211 bp, Homo sapiens
  misc_feature: GYAE6OF01CXFED.49.82.H05.1.454.CMB.1.raw
  modified_base (211)..(211): a, c, t, g, unknown or other
  misc_feature (211)..(211): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctggctgcctggtcaaggactacttcctctctcgactctgagcgggctggcaaggcgcatagn

SEQ ID NO: 168291 - DNA, 166 bp, Homo sapiens
  misc_feature: GYAE6OF01DIWVM.49.82.H05.1.454.CMB.1.raw
  modified_base (166)..(166): a, c, t, g, unknown or other
  misc_feature (166)..(166): n is a, c, g, or t
tcagagtcgagagacacgaccggtgctcgatttagtcgagctctctcgcgggcacgaccggtgctcgatttagtcacgcgagaaagggaaagggggctggccctgacgtgtttctgttcccaccctcctctctctcgactctgagcgggctggcaaggcgcatagn

SEQ ID NO: 168292 - DNA, 519 bp, Homo sapiens
  misc_feature: GYAE6OF01BAO5N.49.82.H05.1.454.CMB.1.raw
  modified_base (401)..(401): a, c, t, g, unknown or other
  misc_feature (401)..(401): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagcccccaaactcatcatttatgaggccgatcagcggccctcaggggtctctgatcgcttctctggctccacgtctggcagcacggcctccctgacatctctgggctcgagtcgtggggacgnggctgatttattattgcttgttcatagtgccggtgatagtggccgtaagggtgttcgggcgggagggaccgaaggtgaccggtctacggtcacgcccaaggcctcgcccccgtggtcc

SEQ ID NO: 168293 - DNA, 523 bp, Homo sapiens
  misc_feature: GYAE6OF01DRSO0.49.82.H05.1.454.CMB.1.raw
  modified_base (299)..(299): a, c, t, g, unknown or other
  misc_feature (299)..(299): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggcaaagcccccaaactcatcatttangaggccgatcagcggccctgagggtctctgatcgcttctctggctccacgtctggcagcacggcctccctgacaatcctcgtcgggctccgaggcgtggggacgaggctgtatttattattgcttgttcatatgccggtgagttagtgggccgtaagggtgttcgggcgggagggacgaaagggtgaccgttcaggtcacgcccaaggctcgccccgtggtacc

SEQ ID NO: 168294 - DNA, 165 bp, Homo sapiens; identical to SEQ ID NO: 168231
  misc_feature: GYAE6OF01BVIUA.49.82.H05.1.454.CMB.1.raw
  modified_base (165)..(165): a, c, t, g, unknown or other
  misc_feature (165)..(165): n is a, c, g, or t

SEQ ID NO: 168295 - DNA, 614 bp, Homo sapiens
  misc_feature: GYAE6OF01D1TE7.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattataacctttctcctggtaccaacaacaccaggcaaagcccccaaatcatcatttatgaggccgatcagcggccctgagggtctctgattcgcttctctggctccacgtctggcagcaccggcctcctgacatctcgtgggctccgaggtcgtaggggacgaggcttggatttagttattgcttgttacattacgtcggccgggttagtagttacggtaggtcccgggtaaaggggttcggttacggggacggggtaacggggaaccgtaaaacggggttcgtaacccgggttccgttaacggggttacccaaaccgggtccccggtaaaacggggtccccttacccgggtcccccccgtttcggggttaacccc

SEQ ID NO: 168296 - DNA, 251 bp, Homo sapiens
  misc_feature: GYAE6OF01EHQ7L.49.82.H05.1.454.CMB.1.raw
  modified_base (248)..(251): a, c, t, g, unknown or other
  misc_feature (248)..(251): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 168297 - DNA, 565 bp, Homo sapiens
  misc_feature: GYAE6OF01CDRI7.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggcccctcaggggtctctgatcgcttctctggctccacgtctggcagcacggcctccctgacaatctctggctccaggctggggacgaggctgatttattattgcttgttcattatggccggttgagttaggtcgggaccggtaaggggttcggttaccgggcgggaaggggacccgaaggggttcggaacccggttccgtagggtccacggtaccccgaagggccctccggtccccccgtcgggttacccc

SEQ ID NO: 168298 - DNA, 516 bp, Homo sapiens
  misc_feature: GYAE6OF01CC3RS.49.82.H05.1.454.CMB.1.raw
  modified_base (222)..(222): a, c, t, g, unknown or other
  misc_feature (222)..(222): n is a, c, g, or t
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacaccaggcaaagccccaaactcatcatttatgaggccgatcagcggccctcaggggtctctgatcgcttctctggctccacgtctggcagcacggcctccctagacaactctctgggctcacggcgtggggacgaggctgtatttattatgtcttgttcatatcgccggttgattggtggaccgtagggtgttcggcggaggacgaaggtgaccgtctaggtcgagccgaaggctcgcccccgtggtcccg

SEQ ID NO: 168299 - DNA, 566 bp, Homo sapiens
  misc_feature: GYAE6OF01D8Z55.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagcccccaaactcatcatttatgaggccgatcagccggccctcgaggggtctctgatcgcttctctggctccacgtctggcagcacggccctccctgacaatctcgtggctccgaggcgtggggacgaggctgtatttattattgtcttgttctagttagtcggtccgggtgtagttaggtcggaccggtaaaggggttggttcggggacgggaagggaacgtaaagggtcggacccggttccgtagggtccaacggcccgaaggcctccggccccccgtggtacccg

SEQ ID NO: 168300 - DNA, 548 bp, Homo sapiens
  misc_feature: GYAE6OF01A7CUN.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgccccaaactcatcatttatgagcgatcagcggccctcagggtctctgatcgcttctctggctccacgtctggcagcacggcctccctgacatctctgggctcccgaggcgtggggacgaggctgtattattattgtctgttcattagtgtccgggtgacgttagggtcggaccggtaagggtgttcggggcgggacgggtaccgaagggtcgtacccggtccgtagggtcgacggcccgaacggcctccggtcccccgtggtacccg

SEQ ID NO: 168301 - DNA, 573 bp, Homo sapiens
  misc_feature: GYAE6OF01EUXMA.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaaactcatcatttatgaggccgatcagcggccctgagggtctctgatcgcttctctcggctccacgtctggcacgcaccggccctccctgacaacttcctcgtgggcctccgaggcgtgggggacaggctgatttattagttgcttgttcattagtcggccgggtgtagttagggtgggacccggtaaggggttcgttacggggacgggaagggaacgtaaaggggtcgacccggttccgtaagggtccaacggtccccaagggccctccggcccccgtggtaccc

SEQ ID NO: 168302 - DNA, 491 bp, Homo sapiens
  misc_feature: GYAE6OF01BYWQ4.49.82.H05.1.454.CMB.1.raw
  modified_base (408)..(408): a, c, t, g, unknown or other
  misc_feature (408)..(408): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaatcatcattatgagcgatcagcgcctcagggtctctgatcgcttctctggctccacgtctggcagcacggcctcctgacaatctcgtgggctccaggctggggacaggctgattatatgntgttcatatgcgtgatagtggccgaaggtgttcggcggagggacgaaggtgacgtcaggtcagccaaggctcgcccctggtcc

SEQ ID NO: 168303 - DNA, 612 bp, Homo sapiens
  misc_feature: GYAE6OF01D1I2Z.49.82.H05.1.454.CMB.1.raw
  modified_base (355)..(355): a, c, t, g, unknown or other
  misc_feature (355)..(355): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctgtaccaacaacaccaggacaaacgcccctaaactcatcatttatgaggccgatcagccgccctcgagggtctctgatcgcttctctggctccacgtcnggcagcacggcctcctgacatctcgtggctccgaggcgtggggacgagggtctagtatttatttagtttcgtcttgttctattacgtcggtccgggttagaagttaggtagggcccgggtaaaggggttcggttacggggacggggtaaggggacccggtaaaggggttcggtaacccggttcccgttaacgggtaccgaaccgggtaccccgaaacgggtcccgttaccccggtcccccccgttccgggttacccg

SEQ ID NO: 168304 - DNA, 532 bp, Homo sapiens
  misc_feature: GYAE6OF01ETGHZ.49.82.H05.1.454.CMB.1.raw
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggcaaacgcccccaaactcatcatttatgaggccatcagcgccctgagggtctctgatcgcttctctggctccacgtctggcagcacggcctcctgacatctcgtggcctccgaggcgtggggacgaggctgtatttattattgtcttgttcagttatcggccggttagagttaggtgggaccgtaaggggttgttcgggtggacgggaccgaagggtcgaccgtccgtaggtcacgcccgaaggcctcgccccgtggtccc

SEQ ID NO: 168305 - DNA, 616 bp, Homo sapiens
  misc_feature: GYAE6OF01D9WJ9.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggcaaacgccccaaactcatcatttatgaggccgatcagcgccctcaggggtctctgatcgcttctctggctccacgtctggcagcacggcctccctgacaatctctgggctccgagcgtggggacgaggctgattattattgtctgttcattagtgtccggtagagttaggtcgggaccggtaaggggttcggtttaccggggacggggtaacgggggaaccggtaaaaggggttaccgggtaaccccgggttaccccggttaaacggggtacccgaaccgggtacccccggaaaacggggtccccgttaccccgggtccccccccgttacggggttacccccg

SEQ ID NO: 168306 - DNA, 164 bp, Homo sapiens; identical to SEQ ID NO: 168239
  misc_feature: GYAE6OF01CN51O.49.82.H05.1.454.CMB.1.raw
  modified_base (164)..(164): a, c, t, g, unknown or other
  misc_feature (164)..(164): n is a, c, g, or t

SEQ ID NO: 168307 - DNA, 528 bp, Homo sapiens
  misc_feature: GYAE6OF01CIPM5.49.82.H05.1.454.CMB.1.raw
  modified_base (223)..(223): a, c, t, g, unknown or other
  misc_feature (223)..(223): n is a, c, g, or t
  modified_base (300)..(300): a, c, t, g, unknown or other
  misc_feature (300)..(300): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattataaccttttctcctggtaccaacaacaccaggacaaacgcccccaaatcatcatttangagcgatcagcgccctcagggtctctgatcgcttctctggctccacgtctggcagcacgcctcctgacaatctctgggcctcgaggcgtcggggacgaggctggtacttattattgcttgttctatatgtccggtgtagtagtcggccgtaagggtggttcggcgggagggaccgaaggtgaccgttccgtaggtcacgcccgaaggcctcgtcccccgtggtacccg

SEQ ID NO: 168308 - DNA, 165 bp, Homo sapiens; identical to SEQ ID NO: 168231
  misc_feature: GYAE6OF01B5VNN.49.82.H05.1.454.CMB.1.raw
  modified_base (165)..(165): a, c, t, g, unknown or other
  misc_feature (165)..(165): n is a, c, g, or t

SEQ ID NO: 168309 - DNA, 546 bp, Homo sapiens
  misc_feature: GYAE6OF01A383I.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctctgtaccaacaacaccaggcaaacgcccccaaactcatcatttatgaggccgatcagcggccctcgagggtctctgactcgcttctctggctccacgtctggcagcacggccctcctgactatcctcgtcgggctccgaggcgtggggacgaggctgtatttatattgcttgttcagttagtcggccggtgagttacggtgggaccggtaaggggtcggttcgggacgggaagggaacgtaaagggtcgacccggtcgtaggtcacgcccgaaggcctcgcccccgtggtaccc

SEQ ID NO: 168310 - DNA, 564 bp, Homo sapiens
  misc_feature: GYAE6OF01C3054.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggccaaagcccccaaactcatcatttatgaggccgatcagccggccctcgaggggtctctgatcgcttctctggctccacgtctggcagcacggcctccctgacaatctctgggctcgagcgtggggacgaggctagatttattagttgcttgttcaagttatcggccggttgattaggtcgggccggtaaggggttcgtttcgggcgggtaagggaccgtaaagggttcggacccggttcgtaacgggtcaacggtccccgaaagggcccttccggccccccgtggtaccc

SEQ ID NO: 168311 - DNA, 114 bp, Homo sapiens
  misc_feature: GYAE6OF01DZRBM.49.82.H05.1.454.CMB.1.raw
  modified_base (113)..(114): a, c, t, g, unknown or other
  misc_feature (113)..(114): n is a, c, g, or t
tcagagtcgagagacacgaccggtgctcgatttagtcgagctctctcgcgggcacgaccggtgctcgatttagtcacgcgagaaagggagagcgggctggcaaggcgcatagnn

SEQ ID NO: 168312 - DNA, 165 bp, Homo sapiens
  misc_feature: GYAE6OF01ELQ6G.49.82.H05.1.454.CMB.1.raw
  modified_base (165)..(165): a, c, t, g, unknown or other
  misc_feature (165)..(165): n is a, c, g, or t
tcagagtcgagagacacgaccggtgctcgatttagtcgagctctctcgcgggcacgaccggtgctcgatttagtcacgcgagaaagggaagggggctggccctgacgtgtttctgttcccgccctcctctctctcgactctgagcgggctggcaaggcgcatagn

SEQ ID NO: 168313 - DNA, 511 bp, Homo sapiens
  misc_feature: GYAE6OF01C0B5J.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagcccccaaactcatcatttatgaggccgatcagccggccctcgaggggtctctgatcgcttctctggctcacgtctggcagcacggccctcctgacaatctcgtgggcctccgaggcgtggggacgagggctgattattattgcttgttcatatgcggtgatgtggcgaagggtgtcgggcggagggacaaagggtgaccgtcgtaggtcagccaaggcctcgccccgtgtcc

SEQ ID NO: 168314 - DNA, 540 bp, Homo sapiens
  misc_feature: GYAE6OF01APCSR.49.82.H05.1.454.CMB.1.raw
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcagcggccctcgaggggtctctgatcgcttctctggctccacgtctggcagcacggcctccctgacatctctggctccgaggcgtggggacgaggctgtattattattgtcttgttcagtatcggccggtgtagttaggtgggtccggtaagggttggttccgggcgggagggaacgaaagggtcgaccggtccgtaggtcgacggcccaaggcctcgcccccgtggtccc

SEQ ID NO: 168315 - DNA, 529 bp, Homo sapiens
  misc_feature: GYAE6OF01CQSTQ.49.82.H05.1.454.CMB.1.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaacgccccaaatcatcatttangagccgatcagcgccctnagggtctcngatcgcttctctgctcacgtctggcagcacggcctcctgacatctcgtggctcaggcgtgggacgaggctgacttattattgtctgttcatatgtccggtgatagtcggaccgtaaggggtgttcggcgggtagggaacgtaaagggtgaccggtccgtacggtacacggtaccccgaaggcccgtacgccccccgtggtacccg

SEQ ID NO: 168316 - DNA, 510 bp, Homo sapiens
  misc_feature: GYAE6OF01EUIO2.49.82.H05.1.454.CMB.1.raw
  modified_base (457)..(457): a, c, t, g, unknown or other
  misc_feature (457)..(457): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggcaaagcccccaaactcatcatttatgaggccgatcagcgccctcaggggtctctgatcgcttctctggctccacgtctggcagcacggcctccctgacaatctctgggctccgaggctggggacgaggctgatttattattgctgttcatatgccggtgataggtggcggaagggtgttcgggnggagggacaaagggtgaccgtcgtaggtcacgcccaaggctcgcccctggtcc

SEQ ID NO: 168317 - DNA, 112 bp, Homo sapiens
  misc_feature: GYAE6OF01D9F9F.49.82.H05.1.454.CMB.1.raw
tcagagtcgagagacacgaccggtgctcgatttagtcgagctctctcgcggcacgaccggtgctcgatttagtcgagctctctcgctctgagcgggctggcaaggcgcatag

SEQ ID NO: 168318 - DNA, 252 bp, Homo sapiens
  misc_feature: GYAE6OF01CXHUU.49.82.H05.1.454.CMB.1.raw
  modified_base (248)..(252): a, c, t, g, unknown or other
  misc_feature (248)..(252): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnnnn

SEQ ID NO: 168319 - DNA, 201 bp, Homo sapiens
  misc_feature: GYAE6OF01DH6W9.49.82.H05.1.454.CMB.1.raw
  modified_base (186)..(201): a, c, t, g, unknown or other
  misc_feature (186)..(201): n is a, c, g, or t
tcagagtcgagagacacgaccggtgctcgatttagtcgagctctctcgcgggcacgaccggtgctcgatttagtcgagctctctcgcgggcacgaccggtgctcgatttagatcacgtgcgtcgcggtgattaaatcgagcaccctcctctctctcgactctgagcgggctggcaaggcgcatagnnnnnnnnnnnnnnnn

SEQ ID NO: 168320 - DNA, 635 bp, Homo sapiens
  misc_feature: GYAE6OF01BTU8Z.49.82.H05.1.454.CMB.1.raw
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggcaaagccccaaatcatcatttangagccgatcagcgacctcgagggtctctgatcgcttcnctggctccacgtctggcagcacggcctcctgacaactctctgggcctcaggccgtggggacgacggcgtagatttacttagtttcgcttgttacctaagtaagtcggcccggttagaagttacgggtgggacccgggttaaaggggttcggtttaccggggacgggtaagggggtaacccggtaaaggggttccggtaacccccgggttcccgttaaaggggttaccccgaaccgggtaaccccccggtaaaggggtccccgttacccgggtcccccccccggtttccggggttaacccccg

SEQ ID NO: 168321 - DNA, 164 bp, Homo sapiens
  misc_feature: GYAE6OF01DH299.49.82.H05.1.454.CMB.1.raw
  modified_base (162)..(164): a, c, t, g, unknown or other
  misc_feature (162)..(164): n is a, c, g, or t
tcagagtcgagagacacgaccggtgctcgatttagtcgagctctctcgcggcacgaccggtgctcgatttagtcacgcgagaaagggaaggggctggccctgacgtgtttctgttcccaccctcctctctctcgactctgagcggctggcaaggcgcatagnnn

SEQ ID NO: 168322 - DNA, 521 bp, Homo sapiens
  misc_feature: GYAE6OF01BHGIS.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcgaggggtctctgatcgcttctctggctccacgtctggcagcacggcctccctgacaatctctgggctcgaggcgtggggacgaggctgtatttattatttgcttgttcatatggccggtgagtagtggccgaaggggtgttcgggcggagggaccgaaggtgaccgtccgtaggtcgagcccaggcctcgccccctggtcc

SEQ ID NO: 168323 - DNA, 144 bp, Homo sapiens
  misc_feature: GYAE6OF01AXV5J.49.82.H05.1.454.CMB.1.raw
tcagagtcgagagacacgaccggtgctcgatttagtcgagctctctcgcgggcacgaccggtgctcgatttagtcgagctctctcgcgggcacgaccggtgctcgatttagtcgagctctcgagcgggctggcaaggcgcatag

SEQ ID NO: 168324 - DNA, 213 bp, Homo sapiens
  misc_feature: GYAE6OF01EXP4P.49.82.H05.1.454.CMB.1.raw
  modified_base (212)..(213): a, c, t, g, unknown or other
  misc_feature (212)..(213): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnn

SEQ ID NO: 168325 - DNA, 549 bp, Homo sapiens
  misc_feature: GYAE6OF01DJSP1.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataactttctctgtaccaacaacaccagacaaacgccccaactcatcattatgaggccgatcagccgccctcgagggtctctgactcgtcttctcgtggcctccgtacgtcgtcggcacgccgaccggccctcccgtgaactaactctacgtggctccgaggcgtgggacgagctgtattattattgcttgtctatagtcgcgtgagtgtggaccggtaagggtcgttcgggcggaagggacgtaaagggtcgtacccggtcgtacggtcgacgtacccgaacggccgtccgcccccgtcggtacccg

SEQ ID NO: 168326 - DNA, 604 bp, Homo sapiens
  misc_feature: GYAE6OF01ECZVZ.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataactttctcctgtaccaacaacaccagcaaacgccccaaactcatcatttatgagccgatcagcgccctcgagggtctctgactcgcttctctggctccacgtctggcagcacggcctcctgactactctcgtcgggctcgaggcgtacggggacgaggctgtaatttattagttgtcttgttacagttagtcggtccggtagtaacgttaggtcgggtacccgggtaaaggggttcggttaccgggacggggtaaagggtaaccggtaaagggtcggtaaccccggttccgttaacgggtaccgaaccggtccccgtaaacggggcccttaccgggtcccccccgttcgggttaaccccg

SEQ ID NO: 168327 - DNA, 260 bp, Homo sapiens
  misc_feature: GYAE6OF01BKGFO.49.82.H05.1.454.CMB.1.raw
  modified_base (249)..(260): a, c, t, g, unknown or other
  misc_feature (249)..(260): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaggctacttcctctctcgactctgagcgggctggcaaggcgcatagnnnnnnnnnnnn

SEQ ID NO: 168328 - DNA, 514 bp, Homo sapiens
  misc_feature: GYAE6OF01BGXSB.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctcgtgggctccgaggcgtggggacgaggctgtattattattgcttgttcatatgccggtgatagtggccgaagggtgtcggcggagggaccgaaggtcgaccgtcgtaggtcacgcccaggctcgcccctggtcc

SEQ ID NO: 168329 - DNA, 524 bp, Homo sapiens
  misc_feature: GYAE6OF01DJ6FQ.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagcccccaaatcatcatttatgaggccgatcagcggccctcgaggggtctctgatcgcttctctggctcacgtctggcagcacggcctcctgacaatctctgggctccgaggcgtgggcgaggctgtattattattgctgttcatatgccgtgataggtggccgtaaggggttgttcgggcggagggacgtaaagggtgaccggttccgtagggtcaacgcccaaggcctcggcccccgtggtaccc

SEQ ID NO: 168330 - DNA, 515 bp, Homo sapiens
  misc_feature: GYAE6OF01CXOPM.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccatctcctgcactgaaaccagcagtgatgttgggaattataacctttctcctggtaccaacaacacccaggcaaagcccccaaactcatcatttatgagccgatcagcgccctcagggtctctgatcgcttctctggctccacgtctggcagcacggcctccctgacaatctctggctccaggcgtggggacgaggctgattattattgcttgttcatatgccgtgatagtggccgaagggtgttcggcgggagggacgtaaagggtgaccggtcgtaggtcacgtcccgaaggctcggcccccgtggtaccc

SEQ ID NO: 168331 - DNA, 241 bp, Homo sapiens
  misc_feature: GYAE6OF01CV02O.49.82.H05.1.454.CMB.1.raw
  modified_base (236)..(241): a, c, t, g, unknown or other
  misc_feature (236)..(241): n is a, c, g, or t
tcagagtcgagagacacgaccggtgctcgatttagtcgagctctctcgcgggcacgaccggtgctcgatttagtcgagctctctcgcgggcacgaccggtgctcgatttagtcgagctctctcggcggcacgaccggtgctcgatttagtcacgcgagaaagggaaggggctgcctgacgtgttctgttcccacctcctctctctcgactctgagcgggctggcaaggcgcatagnnnnnn

SEQ ID NO: 168332 - DNA, 214 bp, Homo sapiens; identical to SEQ ID NO: 168257
  misc_feature: GYAE6OF01BQ3XZ.49.82.H05.1.454.CMB.1.raw
  modified_base (213)..(214): a, c, t, g, unknown or other
  misc_feature (213)..(214): n is a, c, g, or t

SEQ ID NO: 168333 - DNA, 532 bp, Homo sapiens
  misc_feature: GYAE6OF01A7OLF.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctctggtaccaacaacacccaggcaaagcccccaaatcatcatttatgaggccgatcagcgccctcaggggtctctgatcgcttctctggctccacgtctggcagcacggcctcctgacaatctcgtgggctccaggcgtggggacgaggctagtattatcgtgcagctcaatactaacaaactaataaacacgttgggtcgttcgggacggacgggaaccaaacgtcgtaccgtaccgtacgtccacgcccgaaggtcctacgccccctggtcctacccg

SEQ ID NO: 168334 - DNA, 214 bp, Homo sapiens
  misc_feature: GYAE6OF01CTFAV.49.82.H05.1.454.CMB.1.raw
  modified_base (212)..(214): a, c, t, g, unknown or other
  misc_feature (212)..(214): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaagactacttcctctctcgactctgagcgggctggcaaggcgcatagnnn

SEQ ID NO: 168335 - DNA, 640 bp, Homo sapiens
  misc_feature: GYAE6OF01CB0XX.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtccgtgacgcgacgaccgtcccctccgtacgaactaacttccttcggtcggtccctaccggacggtcgggtacggggaacggcgtcgtagttaactttatttagttcgtcgttcgttactaagttagtcgggtccggtagtaagttacgggtacgggtaaccgggtaagggtttccgggttcggggacggggtaacggggtaaacggtaacgggtaccggtacccggttacggtacggtacgacccgtaccggaacggtccgtcccccgtccccggttccggtaacccc

SEQ ID NO: 168336 - DNA, 540 bp, Homo sapiens
  misc_feature: GYAE6OF01CM5YG.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctgtaccaacaacacccaggcaaagcccccaaactcatcatttatgaggccgatcagcggccctcgaggggtctcgtgactcgcttctcgtggcctccacgtctggcagcacgcctcctgacatctcgtggcctcgaggcgtagggcaggctgattattagttgctgttcagttactggccggtgagtaggtgggaccggtaagggttcggttacgggacgggaagggacgtaaagggtgaccggtcgtaggtcgacgacccgaaggcctccgcccccgtggtccc

SEQ ID NO: 168337 - DNA, 249 bp, Homo sapiens
  misc_feature: GYAE6OF01AX5TM.49.82.H05.1.454.CMB.1.raw
  modified_base (246)..(249): a, c, t, g, unknown or other
  misc_feature (246)..(249): n is a, c, g, or t
tcagagtcgagagacacgaccggtgctcgatttagtcgagctctctcgcgggcacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 168338 - DNA, 725 bp, Homo sapiens
  misc_feature: GYAE6OF01A03LA.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatgttaggaattataaccttttctcctggtaccaacaacacccaggacaaacgcccccaaactcatcatttatgaggccgatcagccgccctgaggggtctctgactcgtcttctctacggctcccacgtctggcagccacggccctccctgactaatcctcgtcgggctccgaggcgtacggggacgagggccttagtaacgttttatttagtttcgtacgtttcgtttcgtaacgtttaagttcgggtacccgggtttggtaaagtttacggggttaccgggggacccgggttaaaggggggtttccgggttttcccggggggaccgggggtaaccgggggtaaacccggtaaacgggggttaccgggtaacccccgggtttacccgggttaaccggggtttaacccgaacccggggtaaccccccgtaaacggggggtacccccgtttccccgggtaccccccccccggtttccggggtttaaaccccccg

SEQ ID NO: 168339 - DNA, 612 bp, Homo sapiens
  misc_feature: GYAE6OF01BICEQ.49.82.H05.1.454.CMB.1.raw
  modified_base (223)..(223): a, c, t, g, unknown or other
  misc_feature (223)..(223): n is a, c, g, or t
  modified_base (422)..(422): a, c, t, g, unknown or other
  misc_feature (422)..(422): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattataaccttttctcctggtaccaacaacaccaggacaaacgcccccaaatcatcatttatggaggccgatcacgccggccctacgacgggtctctgactcgtcttctcgtcggcctccgacgtcgtggctagccacggccctcctgactaatcgtcgtcgggctaccgaggtcgtaggggacgnggtctgtactttattattgtcttgtctagttacgtcggtcgggttagagttacggtacggggaccggtaagggttcgggttacgggacggggaacggggtaacggtaaacgggttcggtaacccggttcccggttaaggtcccgaacggtaccccgaaggtcccgtcccgtccccccggtggttaccccg

SEQ ID NO: 168340 - DNA, 617 bp, Homo sapiens
  misc_feature: GYAE6OF01B8ILB.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccatcagcgccctcagggtctctgatcgcttctctggctccacgtctggcagcacggcctccctgacatctctgggctccaggctggggacgaggctgtattattattgtcttgttcagttagtcggtccggtgtagttacggtcgggacccggtaaggggttggttaccggggacggggtaacgggggtaacccgtaaaggggttccgggaaccccgggtttcccggttaacggggttccccgaaacgggtccccccgtaaacgggggtccccttccccgggtcccccccccgtttcggggttaacccccg

SEQ ID NO: 168341 - DNA, 550 bp, Homo sapiens
  misc_feature: GYAE6OF01A5AKN.49.82.H05.1.454.CMB.1.raw
  modified_base (388)..(388): a, c, t, g, unknown or other
  misc_feature (388)..(388): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaacgcccccaaactcatcatttatgaggccgatcagccggccctcgaggggtctctgatcgcttctctggctccacgtctggcagcacggcctccctgacatctctggctcnggcgtgggacgaggctgatttattattgcttgttcattatcggccggtgagttaggtcgggaccggtaaggggttcgttcgggcgggaagggaccgtaagggttcgacccggtccgtaggtccgacgtaccccgaggccctccggtcccccgtcgggtaccc

SEQ ID NO: 168342 - DNA, 220 bp, Homo sapiens
  misc_feature: GYAE6OF01BZCYD.49.82.H05.1.454.CMB.1.raw
  modified_base (212)..(220): a, c, t, g, unknown or other
  misc_feature (212)..(220): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnnn

SEQ ID NO: 168343 - DNA, 732 bp, Homo sapiens
  misc_feature: GYAE6OF01AJMC2.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccngcagtgatgttagggaattacttaaccttttctcctgtaccaacaacaccagacaaacgaccccaaactcatctattatgacggccgatcacgccggccctcgagggtctactgactcgtccttctcgtcgcctaccgtacgtcgtcggcacgcccgaccggtccccttcccgtacgtacctaacttcccgttcggtacgggtcccgttacccgaaggggtccgggttacggggggaaccggacgggtacctttagggtaacttttaacgttttaacgtttcgggttaccttttacggttaaccgttaagttaacggttccggggtaccggttaggtaaggttaacgggttcggggtaaccgggttaaggggggttcggttccgggggaaccggggtaaacggggtaacgtaaacggggtccggtaacccgggttccgtaaccgggtaccgacccgggtaaccccggtagggtaccccgttccccggtccccgggttaccggtaccg

SEQ ID NO: 168344 - DNA, 120 bp, Homo sapiens
  misc_feature: GYAE6OF01AFI17.49.82.H05.1.454.CMB.1.raw
  modified_base (120)..(120): a, c, t, g, unknown or other
  misc_feature (120)..(120): n is a, c, g, or t
tcagagtcgagagacacgaccggtgctcgatttagtcgagctctctcgcgggcacgaccggtgctcgatttagtcgccctcctctctctcgactctgagcgggctggcaaggcgcatagn

SEQ ID NO: 168345 - DNA, 526 bp, Homo sapiens
  misc_feature: GYAE6OF01BHJQK.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcagcggccctcgagggtctctgatcgcttctctcggctccacgtctggcagcacggcctcctgacatctcgtgggctccgaggcgtggggacgaggctgatttattattgcttgttcattatggccggtgagtggtggaccgtaagggtgttcgggcgggagggacgaaggtgaccggttcaggtcacgtcccgaaggcctcgccccgtggtccc

SEQ ID NO: 168346 - DNA, 529 bp, Homo sapiens
  misc_feature: GYAE6OF01BUONL.49.82.H05.1.454.CMB.1.raw
  modified_base (299)..(299): a, c, t, g, unknown or other
  misc_feature (299)..(299): n is a, c, g, or t
  modified_base (357)..(357): a, c, t, g, unknown or other
  misc_feature (357)..(357): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctcctggtaccaacaacaccagcaaacgcccccaaactcatcatttangaggccatcagccggccctcgaggggtctctgatcgcttctctggctccacgtctgcngcacggcctcctgacatctcgtggctccgaggcgtggggacaggtctggattattatgcttgttcatagtcgtccggtagagtaggtggaccgtaaggggtgttcgggagggaagggacgtaaaggtgacccggtcgtacggtcacgtccaaggcctcgccccgtgtacccg

SEQ ID NO: 168347 - DNA, 569 bp, Homo sapiens
  misc_feature: GYAE6OF01AG0XJ.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgagccgatcagcggccctcagggtctctgactcgcttctcgtggcctccacgtctggcagcacggcctccctgacaatctcgtggctcgaggcgtggggacgaggctagattattattgcttgttactattatggccggttgacgttaggtcgggaccggtaaggggttcggttcgggacgggaaggggaacgtaaacgggtcggaacccggttccgtaagggtccacggtaccccgaaggccctcggtccccccgttgggtaccccg

SEQ ID NO: 168348 - DNA, 568 bp, Homo sapiens
  misc_feature: GYAE6OF01AVZK0.49.82.H05.1.454.CMB.1.raw
  modified_base (224)..(224): a, c, t, g, unknown or other
  misc_feature (224)..(224): n is a, c, g, or t
  modified_base (294)..(294): a, c, t, g, unknown or other
  misc_feature (294)..(294): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattataacctttctctgtaccaacaacaccagcaaacgccccaaactcatcatttangaggccgatcagccggccctcgagggtctctgatcgcttctcgtcggctccgacgtctcggcacgcaccggccctccctcgaactactctcgtcgggctccgaggcgtacggggacgaggtctagtatttattagttgcttgtcaattgtcggaccggtgtagttaggtcgggacggtaaggggttcgttcgggacgggagggaccgtaagggtcgaccggtccgtacggtcgaccggacccgaaggtcccgtcccggccccgttcggtacccg

SEQ ID NO: 168349 - DNA, 576 bp, Homo sapiens
  misc_feature: GYAE6OF01C7RVN.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggacaaacgcccccaaactcaatcctatttatgacggccgatcacgcggccctcgaggggtctctgatcgtcttctctggctcacgtctgcagcacgcctcctgactaactctcgtcggctccgaggtcgtaggggacgaggcgtagtacgtttatttagtttgccgtttgtttcaagttagttcggccgggttgagttacggtagggccggtaagggtcggttcgggcgggagggaccgtaagggtcgaccggttccgtacggtcacgcccggtaaggccgtcccgcccccgtcggtacccg

SEQ ID NO: 168350 - DNA, 549 bp, Homo sapiens
  misc_feature: GYAE6OF01A8A61.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaacgcccccaaactcatcatttatgaggccgatcagccggccctcgagggtctctgatcgcttctctggcctccacgtctggcagcacggccctcctgaccaatcctcgtcggctcccgaggcgtggggacgagggtctgtatttattattgtcttgttcattatggccggtgattaggtggaccggtaagggtcggttcgggcgggaagggacgaaagggttgacccggtcgtaggtccacggtcccgaaggcctcggcccccgtggtccc

SEQ ID NO: 168351 - DNA, 547 bp, Homo sapiens
  misc_feature: GYAE6OF01E4IO1.49.82.H05.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccatctcctgcactgaaaccngcagtgatgttaggaatttataaccttttctcctggtaccaacaacaccaggcaaacgcccccaaactcatcatttatgaggccgatcacgccggccctcgaggggtctctgatcgcttctctcggctccacgtctggcagcaccggcctcccagacatctcgtcggctccgaggcgtggggacgaggctgtattattattgtcttgttacattagtgtccggtagtagtaggtggaccggaagggtggtacgggcggacgggaccgaaggtgaccggtccgtacggtcacgcccgacggcctcgcccccgtcggtacccg

SEQ ID NO: 168352 - DNA, 571 bp, Homo sapiens
  misc_feature: GYAE6OF01D7WY0.49.82.H05.1.454.CMB.1.raw
  modified_base (224)..(224): a, c, t, g, unknown or other
  misc_feature (224)..(224): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtacaacaacaccaggcaaacgccccaaactcatcatttatgaggccgatcagccggccctcgaggggtctctgatcgcttctctgctccacgtcnggcagcacgccctccnacaatctcgtcggctcgagcgtggggacgagctgtatttattagttgtcttgttacagttagtcggtcggtgtagttaggtcggtaccggtaagggttcggttcgggacgggtacggggaccgtaacgggtacggtacccggttccgtacgggtccgaacggtaccccggaagggcccgtcccggtccccccgtcgggttccccg

SEQ ID NO: 168353 - DNA, 543 bp, Homo sapiens
  misc_feature: GYAE6OF01EMEJX.49.82.H05.1.454.CMB.1.raw
  modified_base (224)..(224): a, c, t, g, unknown or other
  misc_feature (224)..(224): n is a, c, g, or t
  modified_base (358)..(358): a, c, t, g, unknown or other
  misc_feature (358)..(358): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacacccaggcaaagcccccaaactcatcatttatgaggccgatcagcgccctcgaggggtctctgatcgcttctctggctccacgtctggcngcacggcctccctgacatctcgtgggctccaggcgtggggacgaggctgtatttattattgcttgttcatagtgccgttgagttggtggaccggtaagggttggttacgggcgggaagggacccgtaaagggtggtacccgtcgtaggtccacggccccaaggcctccggcccccgttggtaccc

SEQ ID NO: 168354 - DNA, 112 bp, Homo sapiens
  misc_feature: GYAE6OF01EX5RF.49.82.H05.1.454.CMB.1.raw
tcagagtcgagagacacgaccggtgctcgatttagtcgagctctctcgcgggcacgaccggtgctcgatttagtcgagctctctcgactgagcgggctggcaaggcgcatag

SEQ ID NO: 168355 - DNA, 106 bp, Homo sapiens
  misc_feature: GYAE6OF01COP4S.49.82.H05.1.454.CMB.1.raw
tcagagtcgagagacacgaccggtgctcgatttagtcgagctctctcgcgggcacgaccggtgctcgatttagtcgagctctctagcgggctggcaaggcgcatag

SEQ ID NO: 168356 - DNA, 639 bp, Homo sapiens
  misc_feature: GYAE6OF01C0DJV.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccagacaaacgccccaaactcatcatttatgacgccgatcacgccgcctcgagggtctcgtgactcgcttctcgtcggcctccgtacgtcgtcggcacggccgaccggtccctcccgtagacctaacgttccgtccgtcgggtccctccggaacgggtcggttacgggggaaccgtacgggtcttaggtaactttagtttagttcgtcttgttactaatagttcggtccggtagtagttacggtcgggacgggtaagggttcggttacggggacgggtaacgggaaccgtaaggggttacggtacccggttacggtacgggtaccgaccggtacccgaacggtacccgtcccggtcccccgtcggttaccccg

SEQ ID NO: 168357 - DNA, 548 bp, Homo sapiens
  misc_feature: GYAE6OF01BT5WM.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctctgtaccaacaacaccagacaaacgccccaaactcatcatttatgaggccgatcagcgccctcgagggtctctgatcgcttctctggctccacgtctggcagcacggcctcctgacaatctcgtgggctccgaggcgtgggacgagctgtatttattattgcttgttcatagtggcgtagagttaggtcggaccggtaagggtcggttacgggcgggtaagggaacgaaagggttcggacccggttcgtacgggtacgacggacccgaacggtccctccgtcccccgtcggtaccc

SEQ ID NO: 168358 - DNA, 212 bp, Homo sapiens; identical to SEQ ID NO: 168262
  misc_feature: GYAE6OF01ANPA6.49.82.H05.1.454.CMB.1.raw
  modified_base (212)..(212): a, c, t, g, unknown or other
  misc_feature (212)..(212): n is a, c, g, or t

SEQ ID NO: 168359 - DNA, 392 bp, Homo sapiens
  misc_feature: GYAE6OF01ER0J1.49.82.H05.1.454.CMB.1.raw
  modified_base (229)..(229): a, c, t, g, unknown or other
  misc_feature (229)..(229): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (281)..(282): a, c, t, g, unknown or other
  misc_feature (281)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (364)..(392): a, c, t, g, unknown or other
  misc_feature (364)..(392): n is a, c, g, or t
tcagagtcgagagacacgaccggtgctcgattttagtcgagctctctcgcgggcacgaccggtgctcgtatttaggagtggagctcgttgggtttggggggaagaggaagactgaccggtaccccccaggacgttcaggtgctgggcacagcggccctgggctgcctggtcaagggcctacttcctctctcgactcgtgaggcgggctggcaaggcgcagtaggcagcngncnctcagntccncncncgcncncnctccncgcncnncncngncncncganncncncgcgcgcgcgcgcgngtacgacgtactactccgtccgtccgtcgtcgtcgcggcggcgtcgacgacgacgacganagnnnnnnnnnnnnnnnnnnnnnnnnnnnnn

SEQ ID NO: 168360 - DNA, 538 bp, Homo sapiens
  misc_feature: GYAE6OF01BVN21.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggtacttataattctgtctcctggtaccaacaataccccggcaaagtccccaaactcatgatctttgaggtcagtgatcggcccgcaggggtctctgatcgcttctctggctccacgtctggcagcacggcctccctgacaatctctgggctccaggcgtggggacgaggctgtattattattgcttgttcattatgccggttgagtaggtcgggccgaaggggtcggttcgggcgggtagggaccgtaagggtcggaccgttccgtaggtcgacgacccgaaggcctccggccccctccggg

SEQ ID NO: 168361 - DNA, 643 bp, Homo sapiens
  misc_feature: GYAE6OF01C47Y0.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattattaacctttctctgtaccaacaacaccaggacaaacgccccaaactcatcattatgagcgatcagcgccctcgacgggtctctgactcgtcttctcgtcggtcctccgtacgtcgtcggcacgccgaccggtccctcccgtagaactaacgtccgttcgtcgggcctcccggagggccggtagggggaccggtagggtccttaggttaatttacgtttagtttcgtctttcgtttacaagttacgtcgggttaccgggttagtacgttacggtacgggtaccgggtaaggggttcggttacggggcgggtaacggggaccgtaacgggtcgacccggttaccggtacggtaccgaacggtacccggtaacggtccgtccccggtcccccgtggttaccccg

SEQ ID NO: 168362 - DNA, 645 bp, Homo sapiens
  misc_feature: GYAE6OF01CNKNQ.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcactagaaaccagcagtgatgttaggaattattaaccttttctcctgtaccaacaaccaccagacaaacgaccccaaactcatactatttatagaggaccgatcgagccggtccctcgacgggtctcgtgtactcgtcttcgtcgtcggtcctccgtacgtcgtcggcacgccaccggccctcccgtacgaactaactccgttcgtcgggcctccgaggtcggtacggggacgagggtacttgtaatttagtttacgttgtcttagtttcaagttagtcggtaccgggtagtagttacggtcgggaccggtaaggggttcggttacgggacgggtaagggaacgtaaagggtccggaacccggttccgtaacgggtaccaaccgggtaccccgtaacgggtccctacccgggtcccccgttcgggtaccccg

SEQ ID NO: 168363 - DNA, 631 bp, Homo sapiens
  misc_feature: GYAE6OF01A7N46.49.82.H05.1.454.CMB.1.raw
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctcctgtaccaacaacaccaggacaaacgccccaaactcatcatttangaggccgatcagcgccctcgagggtctctgatcgcttctcgtcgctccgacgttcgtaggccagccaccggtcctaccctgaccaactctcgtcgggcctccgaggtcgtaggggacgacgtcgttagtactttattagttcgtcttgttactaagttacgtcggtcggttagtaagttacgggtacgggaccggtaacggggttgggtaccggggtacgggaaaggggtaacggtaaacggggttccggtaacccggttaccggttacgggtaccgaaccggtaaccccggtaagggtaccccgttcccggtccccccgttcgggtaccccg

SEQ ID NO: 168364 - DNA, 529 bp, Homo sapiens
  misc_feature: GYAE6OF01DDJQX.49.82.H05.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (349)..(349): a, c, t, g, unknown or other
  misc_feature (349)..(349): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcncctgcactgaaaccngcagtgatgttggaattataaccttttctcctggtaccaacaacacccaggcaaacgcccccaaatcatcatttatgaggccgatcagcgccctcgaggggtctctgatcgcttctctggctaccngtctggcagcacggcctcctgacaatctctgggctccgaggcgtgggacgagctgattattattgcttgttcatatggtccgtgagtagtggacggtaagggtcgttcgggcggagggaccgtaagggtgaccggtcgtaaggtccgacgcccgaaggcctccggcccccgtggtacccg

SEQ ID NO: 168365 - DNA, 567 bp, Homo sapiens
  misc_feature: GYAE6OF01BXFMD.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagcccccaaactcatcatttatgaggccgatcagcggccctcgaggggtctctgatcgcttctctggctccacgtctggcagcacggcctccctgacaatctctgggcctccgaggcgtggggacgaggctgatttattattgcttgttcattatggccggttgagttaggtggacccggtaaaggggttcggttcgggcgggaacggggtacccgaagggtcggacccggttccgtagggtccaacggtaccccgaagggtccctccggtccccccgttggtaccccg

SEQ ID NO: 168366 - DNA, 169 bp, Homo sapiens
  misc_feature: GYAE6OF01D8LXY.49.82.H05.1.454.CMB.1.raw
  modified_base (167)..(169): a, c, t, g, unknown or other
  misc_feature (167)..(169): n is a, c, g, or t
tcagagtcgagagacacgaccggtgctcgatttagtcgagctctctcgcgggcacgaccggtgctcgatttagtcgagctctctcgcggcacgaccggtgctcgatttagtcgagctctcccgccatctgatctctcgactctgagcgggctggcaaggcgcatagnnn

SEQ ID NO: 168367 - DNA, 617 bp, Homo sapiens
  misc_feature: GYAE6OF01BGSZS.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgattgttggaattataacctttctctgtaccaacaacaccagacaacgccccaaactcatactatttagtgacggcgatcgagccggcctcgagggtctctgatcgtcttctcgtcgctccgacgtcgtgcgacgcaccgtcctcccgtagaacacttccgtcgtcggcctacgaggcggtacggggacgaggtctagtatttagtattgtctagttctagttagtcggtacggtaggtagttacgggtcggaccgggtaaggggttcggttaccggggacggggtaaacgggtaacggtaaaacggggtcggtaacccgggttccgtacgggtaccgaaccggtacccgtaacgggtccctcccgggtcccccgttccggttacccg

SEQ ID NO: 168368 - DNA, 213 bp, Homo sapiens
  misc_feature: GYAE6OF01C4Q2W.49.82.H05.1.454.CMB.1.raw
  modified_base (212)..(213): a, c, t, g, unknown or other
  misc_feature (212)..(213): n is a, c, g, or t
tcagagtcgagagacacgaccggtgctcgatttagtcgagctctctcgcgggcacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnn

SEQ ID NO: 168369 - DNA, 249 bp, Homo sapiens
  misc_feature: GYAE6OF01BXN1W.49.82.H05.1.454.CMB.1.raw
  modified_base (247)..(249): a, c, t, g, unknown or other
  misc_feature (247)..(249): n is a, c, g, or t
tcagagtcgagagacacgaccggtgctcgatttagtcgagctctctcgcgggcacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnn

SEQ ID NO: 168370 - DNA, 165 bp, Homo sapiens
  misc_feature: GYAE6OF01DI3VM.49.82.H05.1.454.CMB.1.raw
tcagagtcgagagacacgaccggtgctcgatttagtcgagctctctcgcgggcacgaccggtgctcgatttagtcacgcgagaaagggaaagggggctggccctgacgtgtttctgttcccgccctcctctctctcgactctgagcgggctggcaaggcgcatag

SEQ ID NO: 168371 - DNA, 316 bp, Homo sapiens
  misc_feature: GYAE6OF01ERS8K.49.82.H05.1.454.CMB.1.raw
  modified_base (307)..(316): a, c, t, g, unknown or other
  misc_feature (307)..(316): n is a, c, g, or t
tcagagtcgagagacacgaccggtgctcgatttagtcgagctctctcgcgggcacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnnnnnnnnn

SEQ ID NO: 168372 - DNA, 771 bp, Homo sapiens
  misc_feature: GYAE6OF01CXJZ7.49.82.H05.1.454.CMB.1.raw
  modified_base (347)..(347): a, c, t, g, unknown or other
  misc_feature (347)..(347): n is a, c, g, or t
tcagagtcgagagacacgaccggtgctcgatttagtcgagctctctcgcggggggggtcacaagaggcagcgctctcgggacgtctccaccatggcctgggctttgctgctcctcactctcctcactcaggacacagggtcctgggcccagtctgccctgactcagcctgcctccgtgtctgggtctcctggacagtcgatcaccatctcctgcactagaaaaccagcagtgatgttggaaattataaccttttctcctggtaaccaaacaacacccaggacaaacgccccaaatcatctattatgagccatcagccggccctcgagggtctctgactcgtctttcncgtcggcctccgacgtcgtcggcacgccgaccggccctcccgtagaacctaactccgtcgtcgggcccttaccggacgggtccggtacgggggaacgtaacgggtccgttaggtaaacgttttagtttaacgtttcggttaccgtttacggtttacgtaagtttacggttaccgggttacccgggttaggttaaacggttacggggtttaccggggaacccggggttaagggggttccggggtttaaccgggggacccgggggtaaacgggggtaaacccggtaaagggggttacccggtaaaccccgggtttacccggttaaacgggtaccccggtaaacccgggtaacccccggtaaacggggtaccccgttacccccgggtaccccccccgggtttacccgggtacctttaaccccccggg

SEQ ID NO: 168373 - DNA, 234 bp, Homo sapiens
  misc_feature: GYAE6OF01CQ2UQ.49.82.H05.1.454.CMB.1.raw
  modified_base (213)..(234): a, c, t, g, unknown or other
  misc_feature (213)..(234): n is a, c, g, or t
tcagagtcgagagacacgaccggtgctcgatttagtcgagctctctcgcgggcacgaccggtgctcgatttagagagagtgtggttgggttgggggaagaggaagactgacggtccccccaggagttcgaggtgctgggcacagcggccctgggctgcctggtcaaggactacttcctctctcgactctgagcgggctggcaaggcgcatagnnnnnnnnnnnnnnnnnnnnnn

SEQ ID NO: 168374 - DNA, 661 bp, Homo sapiens
  misc_feature: GYAE6OF01CS9F7.49.82.H05.1.454.CMB.1.raw
  modified_base (223)..(223): a, c, t, g, unknown or other
  misc_feature (223)..(223): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactgaaaccngcagtgatgttaggaattataaccttttctctggtaccaacaacaccagacaaacgccccaaactcatactattatcgagccgaatcacgccggccctcgacggggttctacgtgacgttcgctttctcgtcggccttacccncgttcncggtcacggctaccgggtccctcccgtacgaacctaactccgtccgtcgggtcctccgtacggcggtacggggacggacggcgtagtaatttagtttagttgtccgttgttactaattacgtcggtccgggtagtacgtaggtacgggccggtaaaggggttcggttaccggggacgggtaacggggtaaccgtaaacggggttcggaacccggtttcggtaaccgggttaaccgaccggtaccccgtaaggggtcccctaccgggtccccccgtttcgggtacccccg

SEQ ID NO: 168375 - DNA, 578 bp, Homo sapiens
  misc_feature: GYAE6OF01D823P.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctctgtaccaacaacaccaggcaaacgcccccaaactcatcatttatgagccatcagcgccctcgagggtctctgatcgcttctctggctccacgtctggcagcacggtcctcctgacaatctcgtggctcgaggcgtggggacgaggctgtatttattattgtcttgttcagttacgtcggtccggtagtacgttaggtcggacccgggtaaggggttcggttccggggacgggacggggaaccggtaacgggtggtacccggttccgtaagggtcccgaaccggacccgaacgggcccgtcccggtccccccgttcggtaccccg

SEQ ID NO: 168376 - DNA, 578 bp, Homo sapiens
  misc_feature: GYAE6OF01BWF02.49.82.H05.1.454.CMB.1.raw
  modified_base (400)..(400): a, c, t, g, unknown or other
  misc_feature (400)..(400): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataactttctctgtaccaacacaccaggcaaagcccccaaactcatcatttatgaggccgatcagcgccctcgaggggtctctgactcgcttctctggcctccacgtctggcagcaccggcctccctgacaatctcgtggcctccgaggcgtgggacgnggctgtatttagttattgtcttgttctagttacgtcggtccggtagtacgttaggtcgggtaccggtaaggggttcgttacggggacgggaaggggtaacgtaaacgggtcggaacccggttccgtacgggtccacggtaccccgaaggtcccgtccggtccccccgtcggttacccg

SEQ ID NO: 168377 - DNA, 574 bp, Homo sapiens
  misc_feature: GYAE6OF01EUX0S.49.82.H05.1.454.CMB.1.raw
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggacaaacgcccccaaactcatcatttangaggccgatcagcgccctcgagggtctctgatcgcttctctggctccacgtctggcagcacggccctccctgacaatctcgtggcctcgaggcgtggggacgaggtctgatttattattgcttgttacattagtcggccgggtagtagttaggtcggaccggtaaggggtgttccggggcgggaagggacgtaaacgggttcggaacccggttccgtaagggtcccaacggtaccccgaaaggcccgtccggtccccccgtcgggttacccg

SEQ ID NO: 168378 - DNA, 213 bp, Homo sapiens; identical to SEQ ID NO: 168272
  misc_feature: GYAE6OF01CUM1C.49.82.H05.1.454.CMB.1.raw
  modified_base (213)..(213): a, c, t, g, unknown or other
  misc_feature (213)..(213): n is a, c, g, or t

SEQ ID NO: 168379 - DNA, 526 bp, Homo sapiens
  misc_feature: GYAE6OF01EUYQ6.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacaccaggacaaacgccccaaaactcatcatttatgagccgatcagcgccctcgagggtctctgatcgcttctctcggctccacgtctggcagcacggcctcctgacactctctgggctcgaggctgggacgagctgatttattattgctgttcatatggccgtgataggtggaccggtaagggtggttacggcgggagggaacgaaagggtgaccggtcgtacgtcgaacgacccgaaggcctcggccccgtgggtccc

SEQ ID NO: 168380 - DNA, 201 bp, Homo sapiens
  misc_feature: GYAE6OF01EZLZO.49.82.H05.1.454.CMB.1.raw
  modified_base (150)..(150): a, c, t, g, unknown or other
  misc_feature (150)..(150): n is a, c, g, or t
  modified_base (199)..(201): a, c, t, g, unknown or other
  misc_feature (199)..(201): n is a, c, g, or t
tcagagtcgagagacacgaccggtgctcgatttagtcgagctctctcgcgggcacgaccggtgctcgatttagtcgagctctctcgcgggcacgaccggtgctcgatttagtcacgcgagaaagggaaggggctggcctgacgtgtttcngttcccacctctctctctcgactctgagcgggctggcaaggcgcatagnnn

SEQ ID NO: 168381 - DNA, 165 bp, Homo sapiens
  misc_feature: GYAE6OF01C47X9.49.82.H05.1.454.CMB.1.raw
  modified_base (164)..(165): a, c, t, g, unknown or other
  misc_feature (164)..(165): n is a, c, g, or t
tcagagtcgagagacacgaccggtgctcgatttagtcgagctctctcgcgggcacgaccggtgctcgatttagtcacgcgagaaagggaaggggctggccctgacgtgtttctgttcccaccctcctctctctcgactctgagcgggctggcaaggcgcatagnn

SEQ ID NO: 168382 - DNA, 631 bp, Homo sapiens
  misc_feature: GYAE6OF01B2QPA.49.82.H05.1.454.CMB.1.raw
  modified_base (290)..(290): a, c, t, g, unknown or other
  misc_feature (290)..(290): n is a, c, g, or t
  modified_base (350)..(350): a, c, t, g, unknown or other
  misc_feature (350)..(350): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactgaaaccagcagtgatgttaggattatactttctctgtacaacacaccagacaaacgccccaaatcatcatttangagccgatcagccgcctgagggtctcgtgactcgtcttctctcggctccacgtctggacncgcaccgtcctcctagacactctcgtcggcctccaggcgtagggacgacggcgtagtactttagttacttgcttgttactaatagttcggtccgggtagacggttacggtacggggtaccggtaagggggttcggtttacgggggacggggtacggggtaaaccggttaaaacggggtacgggttaaccccggtttcgggtacgggggttaaccccgtacgggtaccccggtaaacgggtccccgttacccgggtacccccccggttcgggttaacccccg

SEQ ID NO: 168383 - DNA, 213 bp, Homo sapiens
  misc_feature: GYAE6OF01DT9NZ.49.82.H05.1.454.CMB.1.raw
  modified_base (211)..(213): a, c, t, g, unknown or other
  misc_feature (211)..(213): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnn

SEQ ID NO: 168384 - DNA, 628 bp, Homo sapiens
  misc_feature: GYAE6OF01BDAYW.49.82.H05.1.454.CMB.1.raw
  modified_base (223)..(223): a, c, t, g, unknown or other
  misc_feature (223)..(223): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacaccaggacaaagcccccaaactcatcatttatgaggccgatcgagtcggccctcgaggggtctcgtgactcgcttctctcggctccacgtctggccagccaccggccctccctgaccaagtcctcgtcgggcctcccgagggcgtgggggacgaggcttaggtatttagttattgactttgttctagttacgtcggtaccgggttgtaagttacgggttcgggacccgggtaaaggggttcgggttccgggtcggggaacgggggtaacgtaaaggggttccggtaacccggttccgttacgggtaccgtacggaccccgtaacggggtcccttacccgggccccccgttcgggtaccccg

SEQ ID NO: 168385 - DNA, 705 bp, Homo sapiens
  misc_feature: GYAE6OF01DUAIP.49.82.H05.1.454.CMB.1.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgccactgaaaccngcagtgattgttaggaattataaccttttctcctgtaaccaacaacaccaggacaaacgccccaaatcatctatttangacgccatcgacgccgccctcgacgggtctcgtgtatccgtcttctcgtcggtcctccgtacgtcgtggacacgaccgtaccggtcccttacccgtagaacctaacgttcgtccggtcgggccttacccggaacgggtcggtacgggggaccgtacgggtcttaggttaacttttagtttacgtttcggttactttcggtttactaagtttacggtcggtaccgggttagtaggtttacgggtacgggtaccggggtaaggggttcgggttacggggaccggggtaaaggggtaaaccggtaaacggggttccggtaaccccggttaccggttacgggtacccgaaccgggtaccccggtaacgggtccctaccccgggtccccccgttcggttaaccccg

SEQ ID NO: 168386 - DNA, 574 bp, Homo sapiens
  misc_feature: GYAE6OF01B05MB.49.82.H05.1.454.CMB.1.raw
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatgttaggaattattaacctttctctagtaccaacaacaccagacaacnccccaaatcatcatttatgacgcatcgacgccgccctcgacgggtctctgtactcgtcttctcgtggtcctcgacgtctcggcacgcaccgcctccnacactctcgtcggctcgaggcgtgggacgngtctagtactttatacgtgtcttgtactagttacgtcggtacgtagtacgtaggtcgggtaccggtagggttcggtacgggcgggtaacgggaccgtaacgggttcgaccggtcgtaacggcgaaccgtacccggtacggcccgtcccggtccccgtcggtaccccg

SEQ ID NO: 168387 - DNA, 554 bp, Homo sapiens
  misc_feature: GYAE6OF01AICAB.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcacgccggccctcgaggggtctctgactcgcttctctcggcctccacgtctggcagccacgccctcctagacaactctcgtcgggctccgaggcgtggggacgaggctagatttattatgcttgttcatatcggccggtgataggtcggaccgtaaggggttgtcgggacgggacgggaccgtacgggtcgacccggttccgtacgggtccacggccccgaaggcctcgcccccgtcggtaccc

SEQ ID NO: 168388 - DNA, 636 bp, Homo sapiens
  misc_feature: GYAE6OF01A32S5.49.82.H05.1.454.CMB.1.raw
  modified_base (375)..(375): a, c, t, g, unknown or other
  misc_feature (375)..(375): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttagggaattataaccttttctcctggtaccaacaaccaccaggacaaacgcccccaaactcatctatttatgacggccgatcgacgccggccctcgaggggtctctgactccgtcttctctcggcctccacgtcgtcggcngccgaccggccctccctagacctattcctcgtcgggccttccggaggtcgtggggacgtagggtctagttatttagttagttcgccgtttagttaccgtaatacggttcggtacccgggttgtaaggtttacgggtcggggtaccgggtaagggggttcggttcggggacggggtaaagggtaacgtaaacggggtcgtacccgggtacgtacgggtaccgacgacccggtacggccgtccccggtccccggtcgtccccg

SEQ ID NO: 168389 - DNA, 507 bp, Homo sapiens
  misc_feature: GYAE6OF01DNX53.49.82.H05.1.454.CMB.1.raw
  modified_base (388)..(388): a, c, t, g, unknown or other
  misc_feature (388)..(388): n is a, c, g, or t
  modified_base (424)..(424): a, c, t, g, unknown or other
  misc_feature (424)..(424): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagccccaaactcatcatttatgagccgatcagcggccctgaggggtctctgatcgcttctctggctccacgtctggcagcacggcctccctgacaatctctgggcctcgnggcgtggggacgagctgattattattgctgttcatntgcgtgagtagtggcgaagggtgtcgggcggaggacgaaggtgaccgtcgtaggtcacgccaaggctccgccccgtggtaccc

SEQ ID NO: 168390 - DNA, 750 bp, Homo sapiens
  misc_feature: GYAE6OF01A0N8X.49.82.H05.1.454.CMB.1.raw
tcagagtcgagagacacgaccggtgctcgatttagtcgagctctctcgcggggggggtctacgtaaggaggcagcgctctccgggacgtctccaccatggccgtggctctgcctggctcctcactctcctcactcaggacacagggtcctgggcccaggtctgccctgactcagcctgcctccgtgtctgggtctcctggacagtcgatcaccatctcctgcactgaaaccagcagtgatgttggaattataacctttctctgtaccaacaacaccagacaacgccccaaactcatctatttatgacgccgatcacgccggccctcgagggtctcgtgactcgtcttcgtcgtgcctccgacgtcgtcgacgacgccgaccggtccctcccgtacgtaacctaactccgttcggtccgggttccgtacccggtaacggggtcgggttaaccgggggggaaccgggtacggggttacccgttaaggttaaacgtttttaacgttttacgttttccgggttacttttacgggtttactaacgtttaaggttccgggtacccggggttaggtaacggtttacgggtaccgggggtaaccggggttaacgggggttccgggtttacgggggaacggggtaacgggggtaaaccggtaaacggggttcccggtaacccgggttacggttaccgggtacgaacccgggtacccggtaaacgggtccccgtcccggtccccccggtcggttaccccg

SEQ ID NO: 168391 - DNA, 688 bp, Homo sapiens
  misc_feature: GYAE6OF01AFZWG.49.82.H05.1.454.CMB.1.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
  modified_base (336)..(336): a, c, t, g, unknown or other
  misc_feature (336)..(336): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattatactttctctgtacaacaacnccagcaacacccccaactcatactactttatcgtcggccgatcacgccggccctacgagggttcctctagtntccgtcttcgtcgtcggccttccgacgtcgtaggcctacgccgaccggtccctccctacgacctaacttccgtccgttcggcctcccgacgggcggtacggggaccggacggtcgtagtacttttagtttacgtcggttcctttaggttactacgttacgttcggtaccgggtaggttaaggttacggttcgggtaccgggtaacggggttcggttacggggaccgggtaaggggtaacccggtaaggggtttaccggacccgggttaacccggttacggggttacccaaccgggtacccccggtaaacgggtccccggttaccccggtccccccggttcggttaacccccg

SEQ ID NO: 168392 - DNA, 108 bp, Homo sapiens
  misc_feature: GYAE6OF01EXWM9.49.82.H05.1.454.CMB.1.raw
  modified_base (107)..(108): a, c, t, g, unknown or other
  misc_feature (107)..(108): n is a, c, g, or t
tcagagtcgagagacacgaccggtgctcgatttagtcgagctctctcgcgggcacgaccggtgctcgatttagtcgagctctctcgcgggctggcaaggcgcatagnn

SEQ ID NO: 168393 - DNA, 114 bp, Homo sapiens
  misc_feature: GYAE6OF01ATRJ8.49.82.H05.1.454.CMB.1.raw
  modified_base (107)..(114): a, c, t, g, unknown or other
  misc_feature (107)..(114): n is a, c, g, or t
tcagagtcgagagacacgaccggtgctcgatttagtcgagctctctcgcgggcacgaccggtgctcgatttagtcgagctctctagcgggctggcaaggcgcatagnnnnnnnn

SEQ ID NO: 168394 - DNA, 675 bp, Homo sapiens
  misc_feature: GYAE6OF01AL6TG.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaaccaccaggacaaacgcccccaaactcatcattatgacgccgatcagccggccctcgacggggtctctgactcgcttctcgtcggctccgacgtctggcagccaccggccctccctagactaactcgtcgtcgggtcctccgagggtccggtacgggggacgacgggtcgttaggtattttacgttagttcgtcgttagtttactaagttacgtcgggtaccgggttagtaacggttagggtcgggtacccgggtaaggggttcggttaccggggacggggtaacggggaaacggtaaacggggttccggtaaccccggttacccggttaacggggttacccgaacgggtaacccccggtaaacgggtccccgttaccccgggtcccccccgttcgggttaacccccg

SEQ ID NO: 168395 - DNA, 584 bp, Homo sapiens
  misc_feature: GYAE6OF01CFF7C.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgtggaattataaccttttctcctggtaccaacaacaccagcaaacgcccccaaactcatcatttatgaggccgatcagccggccctcgaggggtctctgactcgtcttctctcgctccacgtctcggcagccaccggccctcccgtgacctaatcctcgtcgggcctccgaggcgtggggacgaggctagtatttattattgtcttgttcattagtcggtccgggtagtagttaggtcgggtaccgggtaaggggttcggttccggggcgggacggggaacccgtaagggtcggacccggttccgtacggtccgacggtcccgaaggcctcccggtcccccgtcggtacccg

SEQ ID NO: 168396 - DNA, 675 bp, Homo sapiens
  misc_feature: GYAE6OF01E0ACN.49.82.H05.1.454.CMB.1.raw
tcagagtcgagagacacgaccggtgctcgatttagtcgagctctctcgcggggggggtcacaagaggcagcgctctcgggacgtctctaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggacaaacgcccccaaactcatcatttatgaggccgatcagccgccctcgaggggtcctctgatccgtcttctcgtcggcctccgacgttctggccaggccaccggtccctccctagaacctaattcctcgtcgggcctacccgagggcgtgggggacgaggtctgtatttattagttgtcttgttacattagtcggtccgggtagtagttagggtccgggtaccgggtaagggggttcggttaccgggggaccggggaaacgggggtaacccggtaaacgggggtttacccgggtaacccccgggttacccggtttaagggggtaccccaaacggggtaccccccgggtaaacgggtccccgttacccccgggtcccccccccggtttcggggttaaccccc

SEQ ID NO: 168397 - DNA, 715 bp, Homo sapiens
  misc_feature: GYAE6OF01BXM4B.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctctgcactgaaaccngcagtgagttggttaggaatttacttaaccttttctccgtagtaaccaacaaccaccagaccaacgacccccaatcatctatttatgagccatcgacgccggccctgacgggtctacgtgtactcgtctcgtcgtcgtcctcctacgtcgtggcacgcgaccggcctcccgagtactactcgttacgtcgggtcctccggacggcggttacggggacgtacggtacgttagtaacgtttacgttacgtcgactaccgtactaccgtaaacttaactaaaccgtaaaaacctaacgttaaaccgtacggtttacgggggtaccggttaccggggaccgggtaaccccgggtaaaccgttaaaacccgggttcccggtaaccccggttaacccggttaacccggtaccccggtaaacccgggacccccggttaaaccgggtccccttacccccgggttacccccccggttacgggttccccctttaaccccgg

SEQ ID NO: 168398 - DNA, 624 bp, Homo sapiens
  misc_feature: GYAE6OF01AH8P6.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaacgcccccaaactcatcatttatgaggccgatcagcggccctcgagggtctctgactcgtcttctctcggctccacgtctggcagccaccggcctcccgtgaactaactctcgtcggtctcccgaggtcgtggggaccgaggccgtgtaatttattagtttgtcttgtttacagtacgttggaccgggttgaagttacgggtacgggaccggtaaggggtttcgggttccgggaccgggggtaacgggtaacccgtaaagggttccggaacccggtttccggtaccgggtaccgaaccggtaccccggaacggtccccgtcccggtccccccgtcgggttaccccg

SEQ ID NO: 168399 - DNA, 203 bp, Homo sapiens
  misc_feature: GYAE6OF01DK9FC.49.82.H05.1.454.CMB.1.raw
  modified_base (190)..(203): a, c, t, g, unknown or other
  misc_feature (190)..(203): n is a, c, g, or t
tcagagtcgagagacacgaccggtgctcgatttagtcgagctctctcgcgggcacgaccggtgctcgatttagtcgagctctctcgcgggcacgaccggtgctcgatttagcgagctctctcggcgggcacggaccggtgctcgattttagcgagctctcgcggcgggctgggcaagggccgcaattagnnnnnnnnnnnnnn

SEQ ID NO: 168400 - DNA, 218 bp, Homo sapiens
  misc_feature: GYAE6OF01EO81Q.49.82.H05.1.454.CMB.1.raw
  modified_base (207)..(207): a, c, t, g, unknown or other
  misc_feature (207)..(207): n is a, c, g, or t
  modified_base (211)..(218): a, c, t, g, unknown or other
  misc_feature (211)..(218): n is a, c, g, or t
tcagagtcgagagacacgaccggtgctcgatttagtcgagctctctcgcgggacgaccggtgctcgatttagtcgagctctctcgcgggcacgaccggtgctcgatttagtcgagctctcctccgcggcacgccggtgctcgtatttagccgactcgtgttaccccgaccctcctctactctcgactctgagcggctggcaagccgnatgnnnnnnnn

SEQ ID NO: 168401 - DNA, 630 bp, Homo sapiens
  misc_feature: GYAE6OF01CDZ7R.49.82.H05.1.454.CMB.1.raw
  modified_base (224)..(224): a, c, t, g, unknown or other
  misc_feature (224)..(224): n is a, c, g, or t
  modified_base (423)..(423): a, c, t, g, unknown or other
  misc_feature (423)..(423): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatggttggaattataaccttttctctgtacaacaacaccaggaccaaacgacccccaaactcatctatttatgacggccgatcaggccggccctcgacggggtctcgtgactcgtcttcgtctcggcctccgtacgtctggcacgcaccggccctcctgactatcctgtcgggctccgaggtcgtggggacgnggtctagtatttattagttgtcttagttcattagtcggccgggttagagttacggtcggggtaccggtaaggggttcggttaccggggacggggtaacgggtaaacggtaaacggggttccggaacccggttccggtaacgggttacccgacggtaaccccggaacgggtccccgttaccccggtccccccggtgggttaacccccg

SEQ ID NO: 168402 - DNA, 212 bp, Homo sapiens
  misc_feature: GYAE6OF01EQBF4.49.82.H05.1.454.CMB.1.raw
tcagagtcgagagacacgaccggtgctcgatttagtcgagctctctcgcgggcacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatag

SEQ ID NO: 168403 - DNA, 214 bp, Homo sapiens; identical to SEQ ID NO: 168244
  misc_feature: GYAE6OF01CIRK4.49.82.H05.1.454.CMB.1.raw
  modified_base (212)..(214): a, c, t, g, unknown or other
  misc_feature (212)..(214): n is a, c, g, or t

SEQ ID NO: 168404 - DNA, 107 bp, Homo sapiens; identical to SEQ ID NO: 168233
  misc_feature: GYAE6OF01CA595.49.82.H05.1.454.CMB.1.raw
  modified_base (107)..(107): a, c, t, g, unknown or other
  misc_feature (107)..(107): n is a, c, g, or t

SEQ ID NO: 168405 - DNA, 518 bp, Homo sapiens
  misc_feature: GYAE6OF01BGN7K.49.82.H05.1.454.CMB.1.raw
  modified_base (403)..(403): a, c, t, g, unknown or other
  misc_feature (403)..(403): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcagcggccctcgaggggtctctgatcgcttctctggctccacgtctggcagcacggcctccctgacatctctgggctcgaggcgtggggacgnggctgatttatattgctgttcattatgccggtgattaggtggccgaagggtgttcgggacggagggaacgaaggtgaccggtctaggtcacgcccaaggcctcgccccgtggtcc

SEQ ID NO: 168406 - DNA, 493 bp, Homo sapiens
  misc_feature: GYAE6OF01BEN8K.49.82.H05.1.454.CMB.1.raw
  modified_base (375)..(375): a, c, t, g, unknown or other
  misc_feature (375)..(375): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactgaaaccagcagtgatgttgggaattataacctttctcctggtaccaacaacaccaggcaaagcccccaaaatcatcatttaatgaggccaatcagcggccctcaggggtctctgatcgcttctctggctcacgtctggcagcacggctccctgacaatcnctgggctcagctgggacgagctgattatattgctgttcataatgccggtgatatggcaaagggngttggcggagggccaaaggtnaccgtcaggtcagcccaaagctgcccctcggtc

SEQ ID NO: 168407 - DNA, 640 bp, Homo sapiens
  misc_feature: GYAE6OF01B31TR.49.82.H05.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattataaccttttctcctagtacaacaacaccagacaaacgccccaaatcatcatttangacgcatcagccgccctcgagggtctctgtatcgtcttctctgtctcctacgtctggccagccgaccggtccctacccgtagacctaattcctcgtcgggtcctccgacggtcggtacggggacggtacgccgttaggtaattttagttagttcgtccgtttgtttactaattaggttcggtaccggttagaacggttagggtcgggtacccggtaaggggttcgggttacggggaccggggtaacggggaacgtaaaggggtccggtaacccggttccggttacgggtacgaccggtaacccggtaacggtcccgtcccggtccccccgtccgggttacccc

SEQ ID NO: 168408 - DNA, 122 bp, Homo sapiens
  misc_feature: GYAE6OF01CRZFE.49.82.H05.1.454.CMB.1.raw
  modified_base (102)..(102): a, c, t, g, unknown or other
  misc_feature (102)..(102): n is a, c, g, or t
  modified_base (109)..(122): a, c, t, g, unknown or other
  misc_feature (109)..(122): n is a, c, g, or t
tcagagtcgagagacacgaccggtgctcgatttagtcgagctctctcgcgggcacgaccggtgctcgattttagtcgagctctctcgcgggctggcaaggcncataggnnnnnnnnnnnnnn

SEQ ID NO: 168409 - DNA, 773 bp, Homo sapiens
  misc_feature: GYAE6OF01CSSAY.49.82.H05.1.454.CMB.1.raw
  modified_base (224)..(224): a, c, t, g, unknown or other
  misc_feature (224)..(224): n is a, c, g, or t
  modified_base (294)..(294): a, c, t, g, unknown or other
  misc_feature (294)..(294): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccagcaacgccccaaactcatcatttangacgcgatcgacgcgccctcgacgggtctcgtgacttcgtctttctcgtcggcctccgtacggtcgtcggcacgccgtaccggtccctacccgtagtaacctaacgttccgttaccggtcggggtcccttacccgggtacggggtaccggttacgggggggaaccgttacggggtaccgttttagggttaaacttttaacgttttacggttttacggttaccgttttacggtttacttaacgtttaacggttccggggtacccggggtttaaggtaacggtttacggggttaccggggtaaccgggttaaaggggggtttccgggtttaccgggggaacgggggtaacgggggttaaaccggtaaaacggggttcccgggtaaaccccggtttacgggttaaccggggtaacccgaaccgggtaaccccggtaacggggttccccgttaccccgggtccccccggttcgggttaccccg

SEQ ID NO: 168410 - DNA, 551 bp, Homo sapiens
  misc_feature: GYAE6OF01A54RO.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggacaaacgcccccaaactcatcatttatgaggccgatcagccggccctcgaggggtctctgatcgcttctctggcctccacgtctggcagccacggccctcccgtgaaccaatcctcgtcggcctcgaggcgtggggacgaggctgtatttatattgtctgttctatatcggcgttgagttggacggccgtaagggtcgtcgggcggagggaacgaaaggtcggaccggtccgtacggtcgacggacccgaggcctccggcccccgtcggtacccg

SEQ ID NO: 168411 - DNA, 629 bp, Homo sapiens
  misc_feature: GYAE6OF01B58AN.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctggtaccaacaacaccagcaaacgcccccaaactcatcatttatgaggccgatcagccgccctcgagggtctcgtgactcgcttctctggctccacgtcgtggcagcaccggcctccctgacatctcgtcggctccgaggcgtggggacgaggtctgatttattattcgtcttgttcagttagtcggtaccgggttgtaagttaggtcgggtaccggtaaggggttcggttaccggggacggggtaaaggggtaaccgtaaaacggggttccggtaaccccgggttcccggttaacggggtcccgaaacccgggtacccccggtaaacggggtccccttccccgggtccccccccggttccggggtttaacccccg

SEQ ID NO: 168412 - DNA, 624 bp, Homo sapiens
  misc_feature: GYAE6OF01BRAP4.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctctgtaccaacaaccaccagacaaacgccccaaactcatcatttatgaggccgatcgacgccggccctcgagggtctctgactcgcttctctcggacctcaccgtctcggaccacgcgacccggtccctccctacgactaacttctcgtggcctacgcgggcgtaggggacacgggtcgttaggtacttttagtactttcgtcttacggttcattaaggttcggaccggttgtaaggttacgggtaccgggacggttaagggggttcggttaccggggacgggttaaggggaccgtaaagggtcccgaacgggttcccgtaaggtccgaacggtacccggacggtacccgtccccggtccccggtcggtaccc

SEQ ID NO: 168413 - DNA, 581 bp, Homo sapiens
  misc_feature: GYAE6OF01BXK5C.49.82.H05.1.454.CMB.1.raw
tcagagtcgagagacacgaccggtgctcgatttagtcgagctctctcgcggggggggtcacaagaggcagcgctctcgggacgtctccaccatggcctggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggcaaagcccccaaactcatcatttatgaggccatcagccgccctcaggggtctctgatcgcttctctggctccacgtctggcacgcacggcctccctgacaatctctggctccgaggcgtggggacgaggctgatttattattcgcttgttcattaagtcggccggtgtagtaggtcgggaccggaaggggttcggttacgggacgggaaggggacgtaaaacggggttgaacccggttccgtaacgggtaccgaacgggtacccctaaacggggcccttaccgggtcccccccgtggggttacccccg

SEQ ID NO: 168414 - DNA, 599 bp, Homo sapiens
  misc_feature: GYAE6OF01EF37W.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctcctggtaccaacaacaccaggcaaacgcccccaaactcatcatttatgaggccgatcagcggccctcgaggggtctctgatcgcttctctggctccacgtctggcagcacggccctccctgacaatctcgtgggcctcgacggcgtacgggggacgacgggcttcggtatttaagtttagtttgctttcgttctaagtagttcggtccgggttagtaagtacggtgggtacccggtaaggggttcggttcggggacgggagggaacgtaaacggggtcgacccggttacgtaacgggccgaacggccccgaacgggtcccgtccggccccccgtcgggttacccg

SEQ ID NO: 168415 - DNA, 220 bp, Homo sapiens
  misc_feature: GYAE6OF01E24KI.49.82.H05.1.454.CMB.1.raw
  modified_base (212)..(220): a, c, t, g, unknown or other
  misc_feature (212)..(220): n is a, c, g, or t
tcagagtcgagagacacgaccggtgctcgatttagtcgagctctctcgcgggcacgaccggtgctcgatttagatcgtctgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnnn

SEQ ID NO: 168416 - DNA, 508 bp, Homo sapiens
  misc_feature: GYAE6OF01BHVPW.49.82.H05.1.454.CMB.1.raw
  modified_base (495)..(495): a, c, t, g, unknown or other
  misc_feature (495)..(495): n is a, c, g, or t
tcagagtcgagagacacgaccggtgctcgatttagtcgagctctctcgcgggggggtcacaagaggcagcgctctcgggacgtctccaccatggcctggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctggtaccaacaacaccagcaaagcccccaaactcatcatttatgaggccgatcagcgccctcgaggggtctctgatcgcttctctcggctccacgtctggcagcacggcctccctgacatctcgtgggcctccgaggcgtggggacgagggctgatttattattgtctgttcatatgcggtgataggtggaccgtaagggtgtcgggcggagggacgaggtgaccgtcgaggcagccaggccncgccccgtcgtcc

SEQ ID NO: 168417 - DNA, 579 bp, Homo sapiens
  misc_feature: GYAE6OF01EYL5W.49.82.H05.1.454.CMB.1.raw
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgagttgttagggtaattactaaccttttctcctgtaccaacaacaccagaccaaacgcccccaaactcatagtatttagtgcggtacagtaacgccgcctcgacgggtccctgatcgctctctgctacagtcngacacacgtcgcctcctcgaccgtctcgtcggtcctccgggntaggaagtagtcggaggtctagttaatttagtttcgagtacagtctacgtatacgtcgacgaggacagacctaaattagttttgacgtagttacgtcgggacgggaacggtacctaggccgtacggtaccttaccggtacggtaccgaccggtcccgtaacgtcccgtaccccgg

SEQ ID NO: 168418 - DNA, 212 bp, Homo sapiens; identical to SEQ ID NO: 168262
  misc_feature: GYAE6OF01EX6NW.49.82.H05.1.454.CMB.1.raw
  modified_base (212)..(212): a, c, t, g, unknown or other
  misc_feature (212)..(212): n is a, c, g, or t

SEQ ID NO: 168419 - DNA, 694 bp, Homo sapiens
  misc_feature: GYAE6OF01EW3M5.49.82.H05.1.454.CMB.1.raw
  modified_base (230)..(230): a, c, t, g, unknown or other
  misc_feature (230)..(230): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctcgccctgactcagcctgcctccgtgtctgggtctcgtggacagtcgatcacctatcctcctgcactacgaaaccngcagtgagttggttaggtaatttacttaaccttttctcctacggtaaccaaacaaccacccaaggaccaaaccgacccccaaactcatactatttagaggacggaccagtacgacggcccggtcccgtacggtacgggtctccgtttagacttccgtctttctcgtcggtcctccgtacgtctcggcacgaccgacccggtccctacccgtagaacctaacgttccgttccggtcggtccctccggacgggtcgggtaggggaccgtacgggtcctaggttatttactttagttcgttacttcgttactagttacgtcggtacgggttgtaacgtcgggtacgggtaccgggtagggtcggtcgggacggggtaacggaacggtaacgggtccggtacccgtccggttacggtaaccgaccgggtacccgtaacgggtcccgtcccgtcccccggtggtacccg

SEQ ID NO: 168420 - DNA, 164 bp, Homo sapiens
  misc_feature: GYAE6OF01BH1ZJ.49.82.H05.1.454.CMB.1.raw
tcagagtcgagagacacgaccggtgctcgatttagtcgagctctctcgcgggcacgaccggtgctcgatttagtcacgcgagaaagggaagggggctggccctgacgtgtttctgttcccgccctcctctctctcgactctgagcgggctggcaaggcgcatag

SEQ ID NO: 168421 - DNA, 597 bp, Homo sapiens
  misc_feature: GYAE6OF01EMPO1.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggacaaacgccccaaactcatcatttatgacgccgatcacgcggccctcgacgggtctcgtgactcgtcttctctcggcctccgacgtcgtggccaggcaccggtcctccctgacaactctcgtcggcgtccgaggcgtcgggacgacggtcgtagtatttattagttgtcttgttctattagtcgtcggtagtagttacggtacgggtaccggtaacgggttggttacgggacgggaacggggaacggtaaacgggtacggtaccggtccgtacggtacgacggtcccgaaaaaacggccgtacccgtccccgtccggtacccg

SEQ ID NO: 168422 - DNA, 662 bp, Homo sapiens
  misc_feature: GYAE6OF01EUQPD.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgcccctgactcagcctgcctccgtgtctgggtctcctggacagtcgatcaccatctcctgcactgaaaccagcagtgatgttaggaattataacctttctctgtaccaacacaccagcaaacgccccaaactcatcatttagtgaggccgatcacgccgcccgtcgacggggtccctagatccgtctttaccgtctcggcctccgtaaagtcgtacggacaaaccgacccggtccctcccgtcgaacccgttcgtccgtcgggggcccttccgggggcttacggaaacgtagtcggaaggtccttagtaactttttacttcgtggtaccgacgtccttacaagttagtcggaccgacgggtaacgtacggtaaccttaaacgtttaagtttttacggaggttaagtttaccggttaccggggacgggtaaacgggaaccctaaggtcccgttacggaaccccgttcggtaaacgggtccacggtaccccggaaggtcctaccccggg

SEQ ID NO: 168423 - DNA, 595 bp, Homo sapiens
  misc_feature: GYAE6OF01EI2ZN.49.82.H05.1.454.CMB.1.raw
  modified_base (299)..(299): a, c, t, g, unknown or other
  misc_feature (299)..(299): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctggtaccaacaacaccaggcaaacgcccccaaactcatcatttangaggccatcacgcggccctcgacgggtctctgatcgcttctcgtggcctccgacgtctggcagcaccggcctccctgacctatctcgtcgggctacccgaggccgtagggggaccgagggtccgtaggtaacttttagttacgtttcgtcttggtttacaagtttacgtcggtcccgggttagagtttacggtcggggtaccggtaaggggttcggttcgggacggggaagggacccggtaagggtccgaccggttcgtaggtcacgcccgtaaggcctccgccccgtggtacccg

SEQ ID NO: 168424 - DNA, 187 bp, Homo sapiens
  misc_feature: GYAE6OF01CZ0G1.49.82.H05.1.454.CMB.1.raw
  modified_base (157)..(157): a, c, t, g, unknown or other
  misc_feature (157)..(157): n is a, c, g, or t
  modified_base (180)..(187): a, c, t, g, unknown or other
  misc_feature (180)..(187): n is a, c, g, or t
tcagagtcgagagacacgaccggtgctcgatttagtcgagctctctcgcgggcacgaccggtgctcgatttagtcgagctctctcgcggcacgaccggtgctcgatttagcgagctctctcgcgggcacgaccggtgctcgatttagcgagctctcnggcgggctggcaaggcgcatagnnnnnnnn

SEQ ID NO: 168425 - DNA, 721 bp, Homo sapiens
  misc_feature: GYAE6OF01CJ565.49.82.H05.1.454.CMB.1.raw
  modified_base (233)..(233): a, c, t, g, unknown or other
  misc_feature (233)..(233): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgccctccgtgtcgtgggtctccgtggacagtcgatccaccatcctcctgaccactacgaaaccngcagtgatggttaggtaattacttaaccttttctcctacggtaaccaacaaccaccgaggacaaaccgacccccaaatcatactatttatagaggaccatcgacgccgccctaggacgggtctcgtagactcgtcttcgtctcggtcctccgacgttcgtcggacacgccgtacccggtcccttcccgtacgaaccgtaacttccgtccgtcgggcccttaccggacgggtccgggtaacggggacggacgggtaccgttagttacgtttaatttacgttcgtcgtttacgttacgttaacgttaacggtccgggtaccggttaggttaagttacgggtaccggggtacgggtaaggggtttcgggtaccggggtaccgggaaccggggtaaccggaacgggttaccggaaccccggttccggtacggtacccgtaccggtaccccgtaacggtcccgttcccccgggcccccgttccgggttacccc

SEQ ID NO: 168426 - DNA, 691 bp, Homo sapiens
  misc_feature: GYAE6OF01BTEMI.49.82.H05.1.454.CMB.1.raw
  modified_base (224)..(224): a, c, t, g, unknown or other
  misc_feature (224)..(224): n is a, c, g, or t
  modified_base (294)..(294): a, c, t, g, unknown or other
  misc_feature (294)..(294): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccagacaacgccccaaatcatcatttangaggcatcagccgccctcgaggggtctcgtgatcgtcttctcgtcggctccgacgtctggctacgccgaccggccctaccctacgacctaacttccgtccgtcgggtacctcccggacgggcggtacgggggacgacgggtcttcgtaatttagtttagttcgtccgtttgtttacagttaacgtcggtccgggttagtaaggttaacggtccggggtaccgggttaaagggggttccgggtttacggggacccggggtaaacggggtaacccggtaaacgggggttcccggttaaccccgggttccggttaaaccgggttcccgaaacccgggtacccccggtaaacggggtccccgttacccgggttaccccccccgttcggggtttaacccccg

SEQ ID NO: 168427 - DNA, 609 bp, Homo sapiens
  misc_feature: GYAE6OF01CR2DD.49.82.H05.1.454.CMB.1.raw
  modified_base (226)..(226): a, c, t, g, unknown or other
  misc_feature (226)..(226): n is a, c, g, or t
  modified_base (437)..(437): a, c, t, g, unknown or other
  misc_feature (437)..(437): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactagaaaccngcagtgatggttaggaatttacttaaccttttctcctggtaaccaaacaaccacccaggacaaacgcccccaatcactactatttatagacgaccgatcgacgccgtcctcgaggggtcctctgactcgtcttctcgtcggcctcctacgtcgtggcacgccgaccggtccctccgtagactactctcgtggcctcgaggcgtagggacgnggtctgtattattattgtcttgttcattcgtcggtcgtgtagtggtacggacggtaagggtggttcgggacgggtacgggaaacgtaacgggtcgtaaccggttccggtacgggtaccgtaaccggacccggtaacggtcccgtaccccggtccccggttccggttaccccg

SEQ ID NO: 168428 - DNA, 609 bp, Homo sapiens
  misc_feature: GYAE6OF01C3W0K.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattatacctttctcctgtaccaacaacaccagacaaacgccccaactcatcattatgacgcctatcagccgtccctcgacggggtctcgtgactcgtcttctcgtggtcctccgtacgtctcggctcgccgaccggtccctcccgtacgaacctaactcctcgtcgggcctaccgagggcgtcggggacgaggcttagtatttagttagtttgtacttgtttacaagttacgtggtccgggtagtagttacgggtacgggtaccgggtaaggggttcggttcgggacgggtaagggaacgtaaacgggtcgtaccggttccgtaggtccgacggtacccgtaacggccgtcccggcccccgttggtacccg

SEQ ID NO: 168429 - DNA, 667 bp, Homo sapiens
  misc_feature: GYAE6OF01A4ZP0.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcccgcactacgaaaccagcagtgatggttaggaatttattaaccttttctcctacggtaacccaacaaccacccaggaccaaaccgcccccaaactcactctatttatgaggccatcacggccggcccgtcgacgggtctcgtgactcgtcttctcgtcggcctccgacgtctcggcacggccaccggccctacccgtacgaactactccgtcgtcggggtcctccgagggtcggtacggggaccgagggtccgtagtaattttagttagttcggtactttgttaccgtaattcggtcggtaccgggtatacggttacggggtcggtaccggggtaggggtttcggtccggggacggggtaaccgggaaccgtaacggggtccgtacccggtccggtacgggtaccgaccggtaccgtaacgggccctacccgggccccccgttgggtccctacccgg

SEQ ID NO: 168430 - DNA, 535 bp, Homo sapiens
  misc_feature: GYAE6OF01BBXUX.49.82.H05.1.454.CMB.1.raw
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttagggaattataaccttttctcctgtaccaacaacacccaggacaaacgacccccaaactcatctatttatgaggccatcacgcgccctcgagggtctctgactcgcttctcgtgcctccacgtctggcagcgaccggtccctccctagacatcctcgtggcctacgaggcgtggggacaggctgtatttagttntgtcttgttcatagtcgacgtgagtacgnggtacggaggtgtcggcgggaggacgaagggtgaccggtcgtacggtcgacgaccgaggccctccgccccgtgtcc

SEQ ID NO: 168431 - DNA, 217 bp, Homo sapiens
  misc_feature: GYAE6OF01DNGA2.49.82.H05.1.454.CMB.1.raw
  modified_base (207)..(207): a, c, t, g, unknown or other
  misc_feature (207)..(207): n is a, c, g, or t
  modified_base (210)..(217): a, c, t, g, unknown or other
  misc_feature (210)..(217): n is a, c, g, or t
tcagagtcgagagacacgaccggtgctcgatttagtcgagctctctcgcgggcacgaccggtgctcgatttagtagtgtagattccgcgggcacgaccggtgctcgtatttagcacgcgaaggaaagggaaagggggctggcctgacgttgtttctcgttcccaccctcctctctctcgactctgagcgggctggcaaggcgactanagnnnnnnnn

SEQ ID NO: 168432 - DNA, 610 bp, Homo sapiens
  misc_feature: GYAE6OF01BN6XZ.49.82.H05.1.454.CMB.1.raw
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattataacctttctctgtaccaacaacaccagacaaacgaccccaaactcatctatttangaggcatcacgcggcctcgacggggtctcgtgatcgtcttctctcggcctccacgtctggactacgccgaccggccctcccgtagaacctaattcctacgtcgggctccgacggcgtacggggacggtaggcgtagtaactttagttatgttcttcgttactagttagtcggtcggtagtagttacggtgggtacccggtaagggttcggttacgggacgggtaaggggaaaccgtaaagggtcggtaacccggttccgtaacgggtaccgacggtacccggaacggccgttcccgtccccgtcggttacccg

SEQ ID NO: 168433 - DNA, 169 bp, Homo sapiens
  misc_feature: GYAE6OF01BC23X.49.82.H05.1.454.CMB.1.raw
  modified_base (167)..(169): a, c, t, g, unknown or other
  misc_feature (167)..(169): n is a, c, g, or t
tcagagtcgagagacacgaccggtgctcgatttagtcgagctctctcgcgggcacgaccggtgctcgatttagtgtgagtagtttgggtttgggacagaccaacaccagtcttcatcttcccgccatctgatctctcgactctgagcgggctggcaaggcgcatagnnn

SEQ ID NO: 168434 - DNA, 740 bp, Homo sapiens
  misc_feature: GYAE6OF01E2GWB.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactagaaaccngcagtgagtgttggaatttataaccttttctcctagtaaccaacaaccaccgagacaaaccgccccaaactcatcatttagcgacggccgatcgacgtccggtccctcgtacggggtctcgtagacttccgtcttcctcgtcggccttcccgtacgtcgtcggaccacggtcccgtaccggtccccttcccgtacgtaacctaacctttccgttccgtcgggtaccctaccggaacgggtaccgggttacgggggaacccggtaggttaccgttaggtaacgtttttaagtttacgttcggttacgtttacggttaactaggtttacgtacgggtaccggttaggtaacggtttacgggtcgggtaccgggttaagggggttcggttacccgggggacgggtaaacggggaacccggtaaggggttaccggtaaccccgggttcggttaacgggtacccgaccggtaaccccggttaacgggccccgttcccggtccccccggttcggttaccccg

SEQ ID NO: 168435 - DNA, 255 bp, Homo sapiens
  misc_feature: GYAE6OF01C04N7.49.82.H05.1.454.CMB.1.raw
  modified_base (249)..(255): a, c, t, g, unknown or other
  misc_feature (249)..(255): n is a, c, g, or t
tcagagtcgagagacacgaccggtgctcgatttagtcgagctctctcgcgggcacgaccggtgctcgatttagtcgagctctctcgcggcacgaccggtgctcgatttagagagagtgtgttggggtttgggggaagaggaagactgacggtccccccaggagttcaggtgctgggcacagcggccctgggctgcctggtcaaggctacttcctctctcgactctgagcgggctggcaaggcgcatagnnnnnnn

SEQ ID NO: 168436 - DNA, 593 bp, Homo sapiens
  misc_feature: GYAE6OF01CSZT5.49.82.H05.1.454.CMB.1.raw
  modified_base (224)..(224): a, c, t, g, unknown or other
  misc_feature (224)..(224): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcaactgaaaccngcagtgatgttggaattataacctttctcctgtaccaacaacaccaggacaaacgaccccaaactcatacatttatgacgccgatcagccgccctcgagggtctctgatcgtctctcgngtctcacgtctggcngccgtacggccctccctagactaactctcgtcggacctccgaggcggtaggggacgtaggctagtactttattagtttgtcttggttctatacgtcggtcggttagagttaggtacgggtacggtaagggttggttccgggacgggtaacgggaacggtaaacgggtacgtacccggtacgttacggtccgaacggtaccccgaaggtcccgtacccgcccccgtcggttacccg

SEQ ID NO: 168437 - DNA, 731 bp, Homo sapiens
  misc_feature: GYAE6OF01C5XDD.49.82.H05.1.454.CMB.1.raw
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
tcagagtcgagagacacgaccggtgctcgatttagtcgagctctctcgcggggggggtcgacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactagaaaccngcaagtgatgttggaattattacctttctctgtaccaacaacaccaggaccaacgccccaaactcatctattangacggcgatcgacgcgtcccgtcgacggggtctcgtgatcgtcttctcgtcgtctccacgtcgtcgctacgccgtaccggtccctcccgtcgtaacctaacgttccgtccgttcgggtcccgtacccgtacgggtaccgggttacggggggaccggtacgggtcgttacgggttaatttacgttttaacggtttcgttacgtttcggtttaacttaacgtttacggttccggtaccggggttagtaacgggttacgggttacggggtacccggggttaaggggtttccggggttacgggggtaccggggtacggggggtaacccgtaaagggggttacccggtaccccgggttaccggttaccgggtaccgaccggtaaccccggaaccgggttcccttacccgggtccccccggttccggttacccccg

SEQ ID NO: 168438 - DNA, 822 bp, Homo sapiens
  misc_feature: GYAE6OF01A3HR3.49.82.H05.1.454.CMB.1.raw
  modified_base (308)..(308): a, c, t, g, unknown or other
  misc_feature (308)..(308): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatggttaggaattataaccttttctcctggtaaccaacaaccacccaggacaaacgcccccaaactcatcaatttangacggccgatcgacggccgccctcgagggtctcgtgatcgtcttctcgtcggctcccgcgtcgtcggaccagccgtaccggtccccttacccgtagaacctaacgttcccgttaccgtccgggggtacccttccccgggaaggggtcccgggtacggggggaacccgtacggggtaccgtttagggttaacttttaacgttttagtttcggttaccttttaccggtttacttaaacgtttaccggttacgggggttaccccggggttaagtttaacgggtttaacggggttaccggggtaacccggggttaaacgggggggttttccggggtttaacccggggggaaccggggggtaaaacgggggttaaaacccgggtaaaaccggggggttacccggttaaacccccggggtttcccggttaaccggggtacccggtaaacccgggacccccggttaaaccggggtcccccggtttaccccgggtcccccccccgggttccggggttacccc

SEQ ID NO: 168439 - DNA, 575 bp, Homo sapiens
  misc_feature: GYAE6OF01EO1ZG.49.82.H05.1.454.CMB.1.raw
  modified_base (351)..(351): a, c, t, g, unknown or other
  misc_feature (351)..(351): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataacctttctcctggtaccaacaacaccaggacaaacgccccaaactcatcatttatgaggccgatcagcgccctcacggggtctctgatcgcttctctgctcacgtntgcagcacggcctcctgacaatctcgtggctccaggtcgtggggacgagtcgtagtatttattattggcttgttactatagtcggccggtagtacgtaggttcgggaccggtaaaggggtcgttacggggcgggtaaggggacgtaaaacgggtgaacccggttccgtaacgggtaccaacgggtaccccaagggcccgtccggtccccccgtcggttaacccg

SEQ ID NO: 168440 - DNA, 602 bp, Homo sapiens
  misc_feature: GYAE6OF01B2UZU.49.82.H05.1.454.CMB.1.raw
  modified_base (196)..(196): a, c, t, g, unknown or other
  misc_feature (196)..(196): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgcccctgactcagcctgcctccgtgtctgggtctcctggacngtcgatcaccatctcctgcactgaaaccagcagtgatgttaggaattataactttctcctgtaccaacaacaccagacaacgccccaaactcatcatttatgacggccgatcacgccggccctcgaggggtctcgtgatcgtcttctcgtcggtcctcccgtacgtctggcacgcaccggccctccgtagactaactcctcgtcgggcctccgagggtcgtacggggacgagggtctagtatttattagttcgtcgttgttcagttacgtcggtccgggtgtagtaggtcgggacggtaaggggttcggttacggggacgggtacgggtaaccggtagggtacggacccggttaccgacggtacgaccggtacccgacggtcctccggtcccccgtcgggtacccg

SEQ ID NO: 168441 - DNA, 643 bp, Homo sapiens
  misc_feature: GYAE6OF01APM3Q.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacacccaggcaaacgcccccaaactcatcatttatgaggccgatcagccgccctcgaggggtctctgactcgcttctctggcctccacgtctggcagccgaccggccctcccgtgacctaatcctcgtcgggcctcccgaggcgtagggggacgagggcttaggatttagttacgtttgcttgtttactaattagttcggtcccgggttagacgttagggtcgggtacccgggtaaggggttcggttcggggaccggggtaaggggtaaaccgtaaacgggggttcggaaccccgggttccgttaacgggggtacccaaacggtaccccccggtaagggtaccccttcccgggtcccccccgttcggggttaccccg

SEQ ID NO: 168442 - DNA, 251 bp, Homo sapiens
  misc_feature: GYAE6OF01EGG38.49.82.H05.1.454.CMB.1.raw
  modified_base (247)..(251): a, c, t, g, unknown or other
  misc_feature (247)..(251): n is a, c, g, or t
tcagagtcgagagacacgaccggtgctcgatttagtcgagctctctcgcgggcacgaccggtgctcgatttagctctacgctcagggcacgaccggtgctcgatttagagagagtgtgttgggtttggggggaagaggaagactgaccggtcccccaggagttcaggtgctgggcacagcggccctgggctgcctggtcaaggactcttcctcgtagcactctgagcgggctggcaaggcgcatagnnnnn

SEQ ID NO: 168443 - DNA, 698 bp, Homo sapiens
  misc_feature: GYAE6OF01C2561.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggacagtcgatcaccatctcctgcactgaaaccngcagtgagttggttaggaatttacttaaccttttctcctacgtaaccaacaaccaccgagacaaaccgaccccaaactcatactatttacacgacggccatcgacgccgtccctcgacgggtctcgtagactcgtctcgtcgtcggtctccgacgtcgtggacacgccgtaccgtccctccgtacgacctaacgtccttacggtcgggtccctaccggacggggtaccggttagggggaccgtacggttaccgttagttaacgttttagttacgttcgtacttacgttactaagtacgttcgggtaccggttagtaacgttcgggttacggacggggttaagggttcgggttacgggacccgggggtaaacgggtaccgtaacggggttacccgtaaccgggttccgtaacgggtacccgaaccggtaccccggtaacggtcccgttaccccggtcccccgttacggttacccg

SEQ ID NO: 168444 - DNA, 608 bp, Homo sapiens
  misc_feature: GYAE6OF01BBE3A.49.82.H05.1.454.CMB.1.raw
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattataacccttttctcctggtaccaacaacacccaggcaaacgcccccaaactcatcatttangaggccgatcagccggccctcgaggggtctctgatcgcttctctggcctccacgtctggcagccacggcctccctgacatctctgggcctccgaggcgtaggggacgaggctgtatttatttattgtcttggtttcattacgtcggtccgggtagtacgttagggtcgggaccggtaaggggttcggttccgggacggggaacggggtaacccgtaaggggttcggtaaccccggttccggtaacgggttcccacgggtacccccgaagggtcccttcccgggtcccccccgttcgggttacccc

SEQ ID NO: 168445 - DNA, 811 bp, Homo sapiens
  misc_feature: GYAE6OF01DQT05.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctggctctgctgctcctcactctcctcactcaggacacagggtcctgggccagtctgccctgactcagcctgccctccgtgtctgggtctcctggacagtcgatcaccatctcctgcactcgaaaccngcagtgatggttgggaatttattaaccttttctccgtaggttaacccaaacaaaccaacccgaggaaccaaaacgacccccaaaacttcaattcctaatttaatggacggaccgattcgaacggccggtccctcgacggggtctctgtatccgtctttctcgtcggtctacctacggtctacgggcacggcaacggtccctaccctgaactaactccgtacgttcgggcctacccgacgggtacggtaaggggggacccggaagggtacccggttaggtaaacgttttaaagttttacgttttacggtacccgtttacggtttaccgtaatttaacggttaccgggttacccgggttagggtaacggttaacgggttaccgggggtacccgggtaacggggggttttaccgggtttaccgggggtaccgggggaaaccgggggtaacccggtaaaacgggggttaccggttaaccccgggtttaacccgggtaaaccggggtttaccgggaaacccggtaccccccgggtaaaacgggtccccggttaacccggtcccccccccggtttaccgggttaaacccccgg

SEQ ID NO: 168446 - DNA, 740 bp, Homo sapiens
  misc_feature: GYAE6OF01BBJI8.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatctcctgcactagaaaccagcagtgatggttaggtaattattaaccttttctcctacggtaccaacaaccaccaggaccaaaccgaccccaaactcaatctatttatgacggccgatcgagccggccctcgacggggtcttcgtgtactcgtcttctcgtcggtcctccgacgtcgtcggtcacgccgtaccggtccctacccgtagtaacctaacgttcccgtccggtcgggtaccttaccccggacgggtaccgggttacggggggaaccgggtagggtcccgtttaaggttaacgttttaacgtttaacgttttcggtcgttttacggttcgtaagtttacggttcggtcccggggttaagtacgggttacgggttcgggtaccggggtaaggggttcgggtaccggggtacggggtaaacgggtaaccgggtaacgggttccggtaacccggttccggttaaccggtacgaaccccgggtacccggaccggtccccggtacccggtcccccccggttgggttaccccccg

SEQ ID NO: 168447 - DNA, 584 bp, Homo sapiens
  misc_feature: GYAE6OF01COKER.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcactgaaaccngcagtgatgttaggattataaccttttctctgtaccaacaacaccagacaaacgcccccaaatcatcatttatagaggccgatcacgccggccctcgacggggtcctctgactcgtcttcgtctcggctccacgtcgtgcagccaccggcctcctgacatctcgtcggcctcgaggcggtaggggacgaggctagtattattagttgtcttgttactatagtcggtccgtgtagtaggtcgggacggtaaggggtcgggttacgggacgggagggtaacgtaacgggtcgtaacccgggttccgttaagggaccgacggtacccggaacggtccgtcccggcccccgttggttaccccg

SEQ ID NO: 168448 - DNA, 600 bp, Homo sapiens
  misc_feature: GYAE6OF01B36A1.49.82.H05.1.454.CMB.1.raw
  modified_base (300)..(300): a, c, t, g, unknown or other
  misc_feature (300)..(300): n is a, c, g, or t
tcagagtcgagagacacgaccggtgctcgatttagtcgagctctctcgcggggggggtcacaagaggcagcgctctcgggacgtctccaccatggcctggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctctgtaccaacaacaccaggaccaaacgcccccaaactcatctatttangacggccatcagccggccctgacgggtctctgatcgtcttctcgtggcctcccacgtctcggcacgccgaccggccctcccgtgaacctaactcctcgtcgggcctccgacggcgtacggggacgacggtcgttagtaactttattagtttcgctttgttaccattacgtcggtccgggttagtaagttaggtcgggtaccggtaaggggttcgttacggggacgggtagggaacgtaaagggtcgaaccggttcgacggtcgaccgtccgaacggtcctccggtccccgtcggtacccg

SEQ ID NO: 168449 - DNA, 677 bp, Homo sapiens
  misc_feature: GYAE6OF01DHR88.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacacaccaggacaaacgccccaatcatcaatttatgacggccgatcacggccggccctcgacgggtcctctgattcgcttctcgtcggctccgtacgtctggcacgcgaccggtcctccctgaacctaatcctcgtcgggacctccgagggccggtaggggacggtaggtcgttaggtatttactttagttcgtcttggtttacaagtttaacgttcgggtaccgggttaggtaacgttagggttacggggaccgggttaaaggggggtttccgggttacggggaccggggtaacggggaaacgtaaaaacgggggttccgaaccccgggtttacggtaaccgggttaccgaaccgggtacccccggaaacgggtcccgttaccccgggtcccccccggttcggtacccccgg

SEQ ID NO: 168450 - DNA, 214 bp, Homo sapiens; identical to SEQ ID NO: 168244
  misc_feature: GYAE6OF01D646E.49.82.H05.1.454.CMB.1.raw
  modified_base (212)..(214): a, c, t, g, unknown or other
  misc_feature (212)..(214): n is a, c, g, or t

SEQ ID NO: 168451 - DNA, 110 bp, Homo sapiens
  misc_feature: GYAE6OF01AJF3C.49.82.H05.1.454.CMB.1.raw
  modified_base (106)..(110): a, c, t, g, unknown or other
  misc_feature (106)..(110): n is a, c, g, or t
tcagagtcgagagacacgaccggtgctcgatttagtcgagctctctcgcgggcacgaccggtgctcgatttagtcgagctctctgcgggctggcaaggcgcatagnnnnn

SEQ ID NO: 168452 - DNA, 613 bp, Homo sapiens
  misc_feature: GYAE6OF01D3CSA.49.82.H05.1.454.CMB.1.raw
  modified_base (226)..(226): a, c, t, g, unknown or other
  misc_feature (226)..(226): n is a, c, g, or t
  modified_base (488)..(488): a, c, t, g, unknown or other
  misc_feature (488)..(488): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctcgccctgactcagcctgcctccgtgtctgggtctctggacagtcgatcacatctcctgcactacgaaaccngctagtgagttggttaggaatttacttaaccttttctccgtacgtaaccaaaccaaccaccgaagaccaaacgacccccaactacatctatttagcgacggacctatcgaccggccgtcccgtacggtacgggtcctcgtagtactcgtcttctcgtcgcctactcgtctggccagccgacgtccctccgacgtacacgtcctgtcggtctccgagggtcggtaggggacgagtcgtagtatttaattcgttgtcttcgttntaagttcgtgtccgggttataggttaggcgggtacggtaggggttcgtcggggacgggaaaggacgtacgggtacggaccgtcgtacggacaccgtacggacgtccgtcccgtcccgtcgtcccg

SEQ ID NO: 168453 - DNA, 217 bp, Homo sapiens
  misc_feature: GYAE6OF01AZJVJ.49.82.H05.1.454.CMB.1.raw
  modified_base (212)..(217): a, c, t, g, unknown or other
  misc_feature (212)..(217): n is a, c, g, or t
tcagagtcgagagacacgaccggtgctcgatttagtcgagctctctcgcgggcacgaccggtgctcgatttagatcgtctgtgttgggtttgggggaagaggaagactgacggtccccccaggagttcaggtgctgggcacagcggccctgggctgcctggtcaaggactacttcctctctcgactctgagcgggctggcaaggcgcatagnnnnnn

SEQ ID NO: 168454 - DNA, 641 bp, Homo sapiens
  misc_feature: GYAE6OF01A3MIA.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattatacctttctctgtacaacaacaccagacaacgccccaaactcatcattatgaggccgatcacgccgccctcgaggggtctcgtgactcgcttctcgtgcctcctacgtcgtggccacgccgaccggtccctcccgtacgtaactaactccgtcgtcgggcctcccgagggcgtaggggacgaggtctagtatttagttagttcgtcttcgttactagttacgttcggccgggttagtagttacgggttcgggtaccgggtaacggggttcgggttaccgggaccggggaacggggtaaccggtaaggggttaccggtacccggttccggtaacgggtaccgaaccggtaccccggtaaacgggtcccgttccccggtccccccggttccggttaccccg

SEQ ID NO: 168455 - DNA, 611 bp, Homo sapiens
  misc_feature: GYAE6OF01DZE7M.49.82.H05.1.454.CMB.1.raw
  modified_base (365)..(365): a, c, t, g, unknown or other
  misc_feature (365)..(365): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatgttgggaattataaccttttctctgtaccaacaacaccagacaaacgcccccaaatcatctatttatgacggccgatcagccggccctcgagggtctctgactcgtcttctctcgcctcctacgtcgtggcncgccgaccggtccctcccgtagaactaacttccgtccgtggtcctcccgagggtccggtaggggaccgtacgggtcttagtaatttacttagttcgtctttagttcaattacgtggccggttagtaacgttagggtacgggaccgggtaaggggttcggtcggggacggaacgggaaccgtagggtcgtacccggttcgtaacggtcaccggtacccgaggtcccgtccggtcccccgtggtaccc

SEQ ID NO: 168456 - DNA, 732 bp, Homo sapiens
  misc_feature: GYAE6OF01D09VB.49.82.H05.1.454.CMB.1.raw
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttcncctgtaccaacaaccaccaggacaaacgccccaaactcatcatttangaggccgatcacgccgccctcgagggtctctgactcgtcttctcgtcggcctccgtacgtcgtcggcgacgccgaccggtccctaccgtcgaactaactccgtaccgtcgggtcctacccggagggtccggtacgggggtaaccgggacggtaccgtacgttaagttttatttaacgtttcggtcgtttacgttttacctaagttaacggttcgggtaacccggggttgttaaccggttaggggttaccggggtacccggggttaagggggttcgggggtttaccggggaccgggggtaaacggggtaaaccgggtaaaacggggttcccgggtaacccgggtttacccggttaaccgggggtaccgtaacccgggtaccccggtaacgggtccccgttaccccgggtccccccgttcggggttaacccccg

SEQ ID NO: 168457 - DNA, 657 bp, Homo sapiens
  misc_feature: GYAE6OF01AUTBR.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggacaaacgcccccaaatcatcatttatgagccgatcgacgcggccctcgacggggtctcgtgatcgtccttctcgtcggtcctccacgtctggcagccacgcctcctgactaactctacgtcggcctacgaggtccgtaggggacgtaggcttagtatttattagttcgtactttcgttactaagttacgtcggtcccggttagtacgttagggtaccgggaccggttaagggggttccgggttacggggacggggtaaacccgggggtaacccgtaacggggtaccgggtaaccccgggttcccgttaacggggtacccgtaaccgggaccccggtaaacgggtccccgtaccccgggttcccccccgttcgggtacccccg

SEQ ID NO: 168458 - DNA, 644 bp, Homo sapiens
  misc_feature: GYAE6OF01CE4SO.49.82.H05.1.454.CMB.1.raw
  modified_base (223)..(223): a, c, t, g, unknown or other
  misc_feature (223)..(223): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactgaaaccngcagtgatgttaggattactaacctttctctgtaccaacacaccagacaacgaccccaaactcatactatttagtagacggaccgactcgacgccggccctacggacggggttctctgacttccgtccttcgtcgtcggcctccaccgtcgtgcaacgccgaccggtccctcccgtgaacctaacgttctcgtcggggtactcccgagggtccgggtacgggggaccgacgggtcgttaggtaattttagttaacgtttgtacgttgttactaacgttagttccggtacgggttagtagttacggtcgggtacggttaaggggtcgtcgggacgggagggtaaacgtaacgggtccgtaccggtccggtaggtaccaccggtcccgaacggtcccgttacccggccccgttccggtacccg

SEQ ID NO: 168459 - DNA, 287 bp, Homo sapiens
  misc_feature: GYAE6OF01AYC8Y.49.82.H05.1.454.CMB.1.raw
  modified_base (284)..(287): a, c, t, g, unknown or other
  misc_feature (284)..(287): n is a, c, g, or t
tcagagtcgagagacacgaccggtgctcgatttagtcgagctctctcgcgggcacgaccggtgctcgatttagtcgagctctctcgcgggcacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatgnnnn

SEQ ID NO: 168460 - DNA, 538 bp, Homo sapiens
  misc_feature: GYAE6OF01AMWGG.49.82.H05.1.454.CMB.1.raw
  modified_base (377)..(377): a, c, t, g, unknown or other
  misc_feature (377)..(377): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcagccggccctcgaggggtctctgatcgcttctctggcctccacgtctggcagccacggcctcccngactaatctcgtgggcctccgaggcgtggggacgaggcttgatttattattgtctgttcatagtcgacggtgagtggtcggaccggtaggtcggtcggacggagggacgaaggtcgaccgtcgtaggtcgacgacccgaggcctcggtcccccgtggtccc

SEQ ID NO: 168461 - DNA, 671 bp, Homo sapiens
  misc_feature: GYAE6OF01DIQPA.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcgggggggtcacaagaggcagcgctctcgggacgtctccaccatggcctggctctgctgctcctcactctcctcactcaggacacagggtcctgggcccagtctgccctgactcagcctgcctccgtgtctgggtctccgtggacagtcgatccaccatctcctgcactgaaaccngcagtgatgtggaattatactttctctgtaaccaacacaccagacaaacgaccccaaactcatactattatgaggcgactcacgcgcctgacgggtctcgtgactcgtcttcgtacgtcggtcctccgacgtcgtcggacagccgaccggtccctacccgtgaacctaactccgtccgtcgggcctaccggaggaccgttagggggaccgtagggcgttaggttaactttagttaacgtttgtcgtttacggttctaaacgtttacgttcgggtaccggttaggtaacgttacgggtacgggtacccgggtaaagggggtttccggttacggggaccggggtaacggaaccggtaaacggggtacccggtaacccggttaccgtaacgggttcccgaaccggtaccccgaaacgggttccgtcccggcccccgttcggttaaccccg

SEQ ID NO: 168462 - DNA, 192 bp, Homo sapiens
  misc_feature: GYAE6OF01B0AIJ.49.82.H05.1.454.CMB.1.raw
  modified_base (185)..(192): a, c, t, g, unknown or other
  misc_feature (185)..(192): n is a, c, g, or t
tcagagtcgagagacacgaccggtgctcgatttagtcgagctctctcgcgggcacgaccggtgctcgatttagtcgagctctctcgcgggcacgaccggtgctcgatttagatcacgtgcgtcgcgggtgattaaatcgagcacccgtgtctctcgactctgagcgggctggcaaggcgcatagnnnnnnnn

SEQ ID NO: 168463 - DNA, 220 bp, Homo sapiens
  misc_feature: GYAE6OF01E04YS.49.82.H05.1.454.CMB.1.raw
  modified_base (215)..(220): a, c, t, g, unknown or other
  misc_feature (215)..(220): n is a, c, g, or t
tcagagtcgagagacacgaccggtgctcgatttagtcgagctctctcgcgggcacgaccggtgctcgatttagctctacgctcagggcacgaccggtgctcgatttagatagctctcgttgggttggcacgaccggtgctcgatttagatagccctttgtgtcgttccccgccctcctctctctcgactctgagcgggctggcaaggcgcatagnnnnnn

SEQ ID NO: 168464 - DNA, 736 bp, Homo sapiens
  misc_feature: GYAE6OF01ASM3R.49.82.H05.1.454.CMB.1.raw
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
tcagagtcgagagacacgaccggtgctcgatttagtcgagctctctcgcgggggggtcgacgaagaggcagcgctctcgggacgtctccaccatggcctggctctgctgctcctcactctcctcactcaggacacacgggtcctcgggcccagtctcgccctgactcagcctgcctccgtgtctgggtcctcgtggacagtcgatccaccatcctcctgccaatcgaaaccngcaggtnatggttaggattattactttctctacgtactaactacacctacgacaaccgaccccaactacactactacgttatacgaggtacccatacgtaggcccgtacccgtacgtaccggggttctacgtcggaacgtccgtccttttcgtccgttcgggtacccttcccgtaccggtttcaacggggttccaacgcccgtaaccgtccctcccttacggactaacgttcctcgttcccgggccttaccgtacgggaccgggtcggggtaccggtacgggttctaacgggtttactttacgtttacggttcgttaccgtaggttcttaaacgttggttaccggttaccgggttacgtagggttaaccgtacgggggtacgggttaacgggttgggtaccgggtcgggaaacggggtaccggtaagggttcccggtaacgttcccggaaggcccgtaacggtcccggaacgtacggttcccccggtccccgttcgggtacccc

SEQ ID NO: 168465 - DNA, 579 bp, Homo sapiens
  misc_feature: GYAE6OF01AJMCN.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctctgtaccaacaacaccaggacaacgccccaaactcatcattatgaggccatcagaccggcctcgagggtctcgtgactcgcttctcgtcgcctccacgtcgtcggcacgccgacggtccctcctagactaactcgtcgtcgggcctccgtaggcgtcggggaccgacggtctaggtatttagttactcgtctgttacagttacgtcggccggtagtagttcgggtacgggaccggtaagggtcggttcgggacgggtaggaacgtaagggtcgaaccggttccgaaggtccgacggtacccgagggcctcccggtcccctcggtacc

SEQ ID NO: 168466 - DNA, 683 bp, Homo sapiens
  misc_feature: GYAE6OF01BFWPY.49.82.H05.1.454.CMB.1.raw
  modified_base (299)..(299): a, c, t, g, unknown or other
  misc_feature (299)..(299): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacctatcctcctgctactagaaaccagcagtgatggttaggaattattaactttctctgtacaacaacaccagacaacgaccccaatcatctattangagcatcagccgcctacgagggtctcgtgactcgtcttcgtctacggtcctccgtacgtcgtcggcacgcgtacccgggtcccttcccgtacgtacctaacgtccgtcgtacgggccttaccggacgggtccggtacgggggaccggagggtaccgttaggtaattttacgttacgtttcgttccgttaggtttactaacgtttaacggttccggtaccgggttagtacggtttacggcggggtaccgggttaaagggggtcgggttaccggggacgggaaccggggtaaccggtaacggggttaccggtacccggttacggtacgggttaccgacggttacccggaacggtcccgtacccgggtcccccgttgggttaccccg

SEQ ID NO: 168467 - DNA, 511 bp, Homo sapiens
  misc_feature: GYAE6OF01DZYGY.49.82.H05.1.454.CMB.1.raw
  modified_base (223)..(223): a, c, t, g, unknown or other
  misc_feature (223)..(223): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattataactttctctgtaccaacaacaccaggcaaacgcccccaaactcatcatttatgaggccgatcagcgccctgagggtctctgactcgcttctctggctccacgtctgcagcacggcctccgngacactctcgtggctcgnggcgtggggacagctgtattattagtgcttgtcattgcgtccggtagtagtagtcggacggaagggttcgtcggacggaggacgaaggtcgaccgtcgagtcgacgtccaagccgtcgccccgtgtaccg

SEQ ID NO: 168468 - DNA, 668 bp, Homo sapiens
  misc_feature: GYAE6OF01BVHOH.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccngcagtgatgttggaattataaccttttctcctgtaccaacaaccaccagacaaacgacccccaactcatctatttatagacggccgatcgacggccggccctgacggggtcctcgtgatcgtcttcgtcgtcggcctcccgtacgtcgtcggacgacggcctaccgggtccctcccgtacgaactaacttccgtcggtccggtaccgtcccgagggccgggtacgggggacgtagggtcgtagtaatttagttaagttcgtactttcgttactaagttacgtcgggtccggttagtagttacgggtacgggtaccgggttaaggggttcggttaccgggggacgggtaaccgggaaccggtaacgggttaccggtacccggttccggtaacgggtaccgaccgggtacccggacggtccgtcccgtcccccggtcggtacccg

SEQ ID NO: 168469 - DNA, 196 bp, Homo sapiens
  misc_feature: GYAE6OF01EOGQ0.49.82.H05.1.454.CMB.1.raw
  modified_base (176)..(176): a, c, t, g, unknown or other
  misc_feature (176)..(176): n is a, c, g, or t
  modified_base (181)..(196): a, c, t, g, unknown or other
  misc_feature (181)..(196): n is a, c, g, or t
tcagagtcgagagacacgaccggtgctcgatttagtcgagctctctcgcgggcacgaccgtgctcgatttagcgagctctctcgcgggcacgaccggtgctcgatttagcgagctctctcgcgggcacgaccggtgcttcgatttagcgagctctcgtggcgggctggcaaggcanaatgnnnnnnnnnnnnnnnn

SEQ ID NO: 168470 - DNA, 684 bp, Homo sapiens
  misc_feature: GYAE6OF01DWSR7.49.82.H05.1.454.CMB.1.raw
  modified_base (424)..(424): a, c, t, g, unknown or other
  misc_feature (424)..(424): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactacgaaaccagcagtgagtggttaggtaattattaaccttttctcctaggtaccaacaacaccagacaaacgccccaaactcatctattatgaggaccgatcgagcccggcccgtcgagggtctctgactcgtcttctcgtcgtctccacgtcgtcggcacgcaccggtccctcccgtgaacaacttcctacggtcggtcctaccgngggtaccggtgggggaccgcggtcgtagtagtttattagttgtcttcggtttcaagtttacgtcggtaccgggttagtacgttagggtcggtaccggggttaggggttaccggtttcggggaccggggtaacgggaaacccggttaaaggggttaccgggtaaccccggttaccggttaacggggtacccgtaaaccgggtcccccggtaaacggggttccccgtacccccgggtccccccggttccgggtttacccccg

SEQ ID NO: 168471 - DNA, 599 bp, Homo sapiens
  misc_feature: GYAE6OF01B2VYF.49.82.H05.1.454.CMB.1.raw
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatggttggaattacttaaccttttctcctggtaaccaacaaccacccaggccaaacgaccccccaaactcatcatttanggacggccatcgagccgccctcgtaggggtctcgtnagttcgcttctcgtgtcctccacgtctggcagcgaccgcctcctagactactctcgtcggctccgaggcgtgggacgnggctgtacttattgtgtcttgttacattcggtgtccgggtagagttaggtcgggtaccggtaaggggttcggttaccgggngggaacggggaccgtaagggtaccggtaccggttccggtacggtaccgaaccggccccgtaagggtccctcccggtcccccggttcggtacccg

SEQ ID NO: 168472 - DNA, 862 bp, Homo sapiens
  misc_feature: GYAE6OF01BN4VI.49.82.H05.1.454.CMB.1.raw
  modified_base (227)..(227): a, c, t, g, unknown or other
  misc_feature (227)..(227): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctgcctcgtgtcgtgggtctcctggacagtcgatcaccatcctcctgcactagaaaccngcagtgatggtttaggaaatttacttaaccttttctacccgttacggttaacccaaaaccaaccacccgaaggaacccaaaaccgaccccccctaaaactccaattacctaaatttttacgacggtaaccgggacccgtaacgttcccgaaccgggtccccgggtacccccttacggggtaaccgggggtttccttaccggtacggtaccgtttcccgtcctttccgttccgtacgggtcccttacccgtacggttccgtcggaccgacgcccgtacccggtcccttaccccgtagaaccctagttcccttcggtccggtcctccggaacgggttccgggtacgggggaaccgtacggggtaccgtttagttaacgtttttaaacgtttcgttacggttcctttgttaaccgttagttaacgttcgggtacccgggttaggtaacgtttaagggggcggggtaacccgggtttagggggttaccgggttaccggggggacggggtaaaacgggtaacccgggtaaacgggttacccggggttaacccggtttccggtaaaccgggttaccgaaacccgggtccccggtacgggtaccccggtcccccgggttaccccccgttcgggttaaccccc

SEQ ID NO: 168473 - DNA, 657 bp, Homo sapiens
  misc_feature: GYAE6OF01BHMXJ.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccgcagtgatgtggaattataacctttctctgtaccaacaacaccaggcaaacgcccccaaactcatacatttatgaggaccatcagccgcctcgagggtctcgtgactcgcttctctcggctccacgtctcggcagccaccgggccctacccgtagaacctaacgttcctcgttcgggaccttccggaacgggtccggttacgggggacgacgggtcctaggttaactttagttacgttcggtaccttgttacctagttaacgtcggtccggtaggtacgttacgggtcgggacccggtaaggggttcgggttaccgggacggggaaaggggtaaaccgtaaagggttaccggaaacccggttccggttaacgggaccgaaccggaccccggtaacggtaccccgtcccggtaccccccgttccggttaaccccgg

SEQ ID NO: 168474 - DNA, 702 bp, Homo sapiens
  misc_feature: GYAE6OF01B0622.49.82.H05.1.454.CMB.1.raw
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttggaattattaaccttttctcctgtaccaacaaccaccagacaaacgacccccaaatcatctattangacggccatcacgccggcccgtcgacggggtctcgtgacgtcgtcttctcgtcggcctcccgtacgtcgtcggcgtacgccgacccggtcccgtcccctacggaacctaacgttcctaccggttcgggtccctacccggaggggtccggttacggggggaaccggacgggtccgttaggttaagttttaatttagtttcgtcgtttgtttacgtagtttaagttcgggtacccgggttaggtaaggtttacgggtccggggtaccggggtaacgggggtttcgggttaccggggaccggggaagggggtaacgtaaacggggttcgtacccgggttccggtacggtaccgaaccgaccccggtaacgggtccgtaccccggtccccccgtcgggtacccc

SEQ ID NO: 168475 - DNA, 585 bp, Homo sapiens
  misc_feature: GYAE6OF01AI058.49.82.H05.1.454.CMB.1.raw
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacacccaggcaaacgcccccaaactcatcatttatgaggccgatcagcggccctcgaggggtctctgatcgcttctctggctccacgtctggcagcacggcctcccngacatctcgtgggcctcgnggcgtggggacgagggctaggtacttagtttattgtcttgttctagtacgtcggccgggttagtagttaggtcgggaccggtaaggggtcgttcgggacggggaaggggtaccgtaaaggggttccggacccggttccgtacgggtccgacggtaccccgaaggtcccgtccggtcccccccgtgggtacccc

SEQ ID NO: 168476 - DNA, 673 bp, Homo sapiens
  misc_feature: GYAE6OF01BL8V2.49.82.H05.1.454.CMB.1.raw
  modified_base (223)..(223): a, c, t, g, unknown or other
  misc_feature (223)..(223): n is a, c, g, or t
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatcaccatctcctgcactagaaaccngcagtgattggtaggtaattacttaacctttctccgtacgtaccaacaacaccagacaacgccccaatcatctattagnggacggcctatcgacgccgacccgtgtacgggtctactggactcgtcttcgtcgtcgcctaccgacgtcgtcggacacgccgtaccggtccctccgacgtaacctacttccgtcgtcgggtcctaccggtacggtcggtacggggaccgacggtacgttagttagtttagttacgttcgttacttgttacgtagttacggtccggtacgggttaagttacggttagggtaccgggtaccgggttaagggttccgggttacggggaaccgggtaacgggtaacccggtacgggtaccgtacccggttccggaaccggtcccgaaccgggtcccgtaaccggtcccgtaacccggtccccggtccgttacccg

SEQ ID NO: 168477 - DNA, 174 bp, Homo sapiens
  misc_feature: GYAE6OF01BZRDY.49.82.H05.1.454.CMB.1.raw
  modified_base (122)..(122): a, c, t, g, unknown or other
  misc_feature (122)..(122): n is a, c, g, or t
  modified_base (166)..(174): a, c, t, g, unknown or other
  misc_feature (166)..(174): n is a, c, g, or t
tcagagtcgagagacacgaccggtgctcgatttagtcgagctctctcgcgggcacgaccggtgctcgatttagtcacgcgagaaagggaagggggctggccctgacgtgtctctgttccccnccctcctctctctcgactctgagcgggctggcaaggcgcatagnnnnnnnnn

SEQ ID NO: 168478 - DNA, 113 bp, Homo sapiens
  misc_feature: GYAE6OF01BFN2O.49.82.H05.1.454.CMB.1.raw
  modified_base (110)..(113): a, c, t, g, unknown or other
  misc_feature (110)..(113): n is a, c, g, or t
tcagagtcgagagacacgaccggtgctcgatttagtcgagctctctcgcgggcacgaccggtgctcgatttagcacacgatagttgggttggcgtggcaaggcgcatagnnnn

SEQ ID NO: 168479 - DNA, 665 bp, Homo sapiens
  misc_feature: GYAE6OF01BAHPJ.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtcgtgggtctctggacagtcgatcaccatcctcctgcactacgaaaccagcagtgagttgttagggaactttacttaaccttttctcctacgtaaccaaacaacaccacggaccaaaccgaccccaaactctatactattagcgacgcgtatacgcggccgcccgtacggacgggtcctacgtgactcgtcttcgtcgtcgcctctacgtcgtcggcgacgcgaccgtccctacctacgaacctacgttccgtacggtcggccgtaccggtcgggacggtacggggacggacgttacgttagttaatttagtttcgtcgttacgtcgttacagtacgtcgggtacgttaggtacgttagggccgggtacgggtaagggttcggtacggggaacggaagggtaaccgtaacgggtccgtaaccggttcgttaacgggtcccgaaacggcccggtacgggccttcccccgggtccccgtggttaccccg

SEQ ID NO: 168480 - DNA, 589 bp, Homo sapiens
  misc_feature: GYAE6OF01BGQYI.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgattgttgggaattataaccttttctcctggtaccaacaaccaccaggacaaacgcccccaaactcatcattatgagccgatcacgccggccctcgagggtctctgactcgtcttctctggcctccacgtctggcagcaccggcctcctagactaactctcgtcggctccgaggcgtggggacgaggctagtattattagttcgtctgttacatagtcggccggtagtaacgttgggtacggacggtaacggggtcgttaccggggacgggtaagggtaaccgtaaaacggggtcgaacccggttcgtaacgggtcgaacggtcccgtaaagggccctccggtcccccgttcggtacccg

SEQ ID NO: 168481 - DNA, 518 bp, Homo sapiens
  misc_feature: GYAE6OF01CNKXP.49.82.H05.1.454.CMB.1.raw
  modified_base (224)..(224): a, c, t, g, unknown or other
  misc_feature (224)..(224): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggttaccaacaacacccaggcaaagcccccaaatcatcatttatgagccatcagcgccctcaggggtctctgatcgcttctctggctcacgtctggcagcacggctccctgacaatcnctggctcagcgtgggacgaggctgnttattatgtctgttcatatgccgtgatgtcggcgtaaggtggttcggcggagggacgaaacgggtgaccggttccgtaagggtcgaacgtcccaacggctaccgcccccgtggtacccg

SEQ ID NO: 168482 - DNA, 578 bp, Homo sapiens
  misc_feature: GYAE6OF01BGH0G.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccctttctcctggtaccaacaacacccaggcaaacgcccccaaactcatcatttatgaggccgatcagtgccctcgagggtctctgatcgcttctctggctccacgtctggcagcacggcctcctgacatctctggctcgaggcgtggggacgaggctagtactttattacttcgtcttgttacattacgtgcccgggttagagttaggtcgggccggtaaaggggttggttaccgggcgggtaagggaaccgtaaagggttcggacccggttcccgtaagggttcccaacggaccccgaacgggtccctccggtccccccgttcgggtaccc

SEQ ID NO: 168483 - DNA, 764 bp, Homo sapiens
  misc_feature: GYAE6OF01BQNAF.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctcgccctgactcagcctcgcctccgtgtctgggtctccgtggacagtcgactcactatcctctgcacgtacgaaccagcgagtggtagttggttaggtaactttacttaacctttcgttccgtacggtaaaccaacctaaaccacctaaggaccaaaccgtaccccctaaactcactactagtttacgcggaacggtccgtaatcgacggtccggtacctacggtacgggtacttactacggtacgtcccggtactttccgtcgtaccggtcctacccgttaccgtggttaccgggacctacggtacccgtacccgggtaccctacccgtaagtaaccgtaaccgttccggtaaccgtcgggtacccgtacggtacgggtacgggtacggggacgtacgggtacttacgtttaagttacgtttagtcggttacgttcgttaactaacgttacggtacgggtaccggttagtaacgggttcgggtacggtacggggtagggtacggtcggggaccggggtaagggtaacggtaacgggtacgttacccgggttacgaccgggttacaccggtaccgtacgggaccctcccgggtaacccggttcggtacccg

SEQ ID NO: 168484 - DNA, 568 bp, Homo sapiens
  misc_feature: GYAE6OF01ANZZO.49.82.H05.1.454.CMB.1.raw
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
  modified_base (323)..(323): a, c, t, g, unknown or other
  misc_feature (323)..(323): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
tcagagtcgagagacacgaccggtgctcgatttagtcgagctctctcgcggggggggtcgacaagaggcagcgctctcgggacgtctccaccatggcctgggctctgctgctcctcactctcctcactcaggacacagggtcctgggcccagtctcgccctgactcagcctcgcctccgtgtctgggtcctcgtggacagtcgactcacctatctcctgacactagaaaccngcagtgatggttaggtaattacttaccttttacncgtacgtaccaacaccaccgaagaccaaaccgccccaactctactactaatttacgnggacggcgtatccgacggtccgaccctggacgggtctactcgtatccgtcttctcgacgtcctacncggtntcgctacgccgaccgcctacgnactactcgtcgcgtacncgaggcgtcgggancgtgtgttattagttgtcggtctacgttatcgtagtcggtagtgtaagtcgtagggccgttaggcggtggaccggaggctaggcacggtctcgtagctacgacgtcggctcccggtctcgg

SEQ ID NO: 168485 - DNA, 697 bp, Homo sapiens
  misc_feature: GYAE6OF01D8Z6Q.49.82.H05.1.454.CMB.1.raw
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactagaaaccagcagtgattggttaggaatttattaaccttttctcctaggtaccaaccaacaccaggaccaaacgccccaaactcatcatttanggaggccgancagcgcctcgagggtcnctgactcgcttcncgtcgctccacgtctcggacacgcgaccgtccctacccgtagacctaactccgtcgtcgggtcctacggaggccggtagggggaccacgggtcgttagtattttattacgtttgccgtttgttctaagtttagtcggtaccggttagtacgttacggtcgggtaccgggttaaaggggttcggttaccgggggtaacgggtaacgggggtaaaccggttaaacgggggttacccgggtaaccccgggtttccccggtttaacgggtacccggtaaaccggtaccccccgggaaacgggtaccccgtttcccccggggtccccccccgttcggggtttaacccccccg

SEQ ID NO: 168486 - DNA, 109 bp, Homo sapiens
  misc_feature: GYAE6OF01EL4X9.49.82.H05.1.454.CMB.1.raw
  modified_base (107)..(109): a, c, t, g, unknown or other
  misc_feature (107)..(109): n is a, c, g, or t
tcagagtcgagagacacgaccggtgctcgatttagtcgagctctctcgcgggcacgaccggtgctcgatttagtcgagctctcgagcgggctggcaaggcgcatagnnn

SEQ ID NO: 168487 - DNA, 106 bp, Homo sapiens
  misc_feature: GYAE6OF01BYU10.49.82.H05.1.454.CMB.1.raw
  modified_base (106)..(106): a, c, t, g, unknown or other
  misc_feature (106)..(106): n is a, c, g, or t
tcagagtcgagagacacgaccggtgctcgatttagtcgagctctctcgcgggacgaccggtgctcgatttagtcgagctctctcgcgggctggcaaggcgcatagn

SEQ ID NO: 168488 - DNA, 613 bp, Homo sapiens
  misc_feature: GYAE6OF01BAJZ0.49.82.H05.1.454.CMB.1.raw
  modified_base (223)..(223): a, c, t, g, unknown or other
  misc_feature (223)..(223): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacaccaggcaaacgccccaaactcatcatttatgagtccgatcgagcggccctcgagggtctcgtgtctcgcttctcgtgctccacgtctggcacgcgtaccggcctcctgacaatcctcgttgggccttcgaggcgtgggacgtaggctagatttattcgttgcttggttctagtagttcggccgggttgtaagttaggtcggtacccgggtaaggggttcgttaccggggaccggggtaagggtaacccggtaaaggggttccgtaacccgggttcccgtaagggttcccgaaccggtaccccgaaacggggtccttcccggggtccccccttaaggggttccccc

SEQ ID NO: 168489 - DNA, 257 bp, Homo sapiens
  misc_feature: GYAE6OF01CI7X6.49.82.H05.1.454.CMB.1.raw
  modified_base (250)..(257): a, c, t, g, unknown or other
  misc_feature (250)..(257): n is a, c, g, or t
tcagagtcgagagacacgaccggtgctcgatttagtcgagctctctcgcgggcacgaccggtgctcgatttagtcgagctctctcgcgggcacgaccggtgctcgactttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnn

SEQ ID NO: 168490 - DNA, 218 bp, Homo sapiens
  misc_feature: GYAE6OF01A5J5C.49.82.H05.1.454.CMB.1.raw
  modified_base (211)..(218): a, c, t, g, unknown or other
  misc_feature (211)..(218): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcggctggcaaggcgcatagnnnnnnnn

SEQ ID NO: 168491 - DNA, 719 bp, Homo sapiens
  misc_feature: GYAE6OF01A5CB6.49.82.H05.1.454.CMB.1.raw
  modified_base (301)..(301): a, c, t, g, unknown or other
  misc_feature (301)..(301): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggccagtctgccctgactcagcctgcctccgtgtctgggtctctggacagtcgatcacatctctgcactagaaaccagcagtgattgttagggtaattattaacctttctcctggtaccaacaacaccaggacaaacgaccccaactcactcattangagcgatcacgcgcctcgacgggtctcgtgatcgtcttctcgtcgcctcccgtacgtcgtcggcgacgccgaccggtccctaccctagaacctacgttcctcgtacgggtcctacccggagggtcggtacgggggaccgtacgggctttacgggtattttaacgtttacgttcgttacgttcgtttacgtaattacggtcgggtaccgggttagtaaggttacgggttcgggtaccggggtaacggggtttccggggttaccgggggtaccggggaaacggggtaacccgggtaacgggggttaacccggtaccccggggtttaccggttaaccgggtcccgtaaaccgggtaccccccgggtaacgggtacccccggttccccgggtaccccccccggttcgggtttaaacccccgg

SEQ ID NO: 168492 - DNA, 219 bp, Homo sapiens
  misc_feature: GYAE6OF01DTQAN.49.82.H05.1.454.CMB.1.raw
  modified_base (212)..(219): a, c, t, g, unknown or other
  misc_feature (212)..(219): n is a, c, g, or t
tcagagtcgagagacacgaccggtgctcgatttagtcgagctctctcgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnn

SEQ ID NO: 168493 - DNA, 633 bp, Homo sapiens
  misc_feature: GYAE6OF01E26ZM.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgagtggttagggtaaatttactaaaccctttttcttaccttcggtaacccaaaccaaccaccctaggacaaacgacccccaaactcatctatttatggaggccgatcgagccgccctcgaggggttctcgtgtacgtcgtccttctcgtcgcctccgtaccgtcgtcggcacgcgacggtccctacccgtgaccaatcctcgtcggcctccgaggcgtggggacgtaggctagtaattattagtgtctgttctagtacgtcggtaccggtagtagttacggtcggaccgggtaagggtcggttacgggacgggtaagggtaacggtaaaggttccggaccggttccgtaacgggtacgaccggtacccgaacggtcccgtccccggtcccccgtcggtaccccg

SEQ ID NO: 168494 - DNA, 270 bp, Homo sapiens
  misc_feature: GYAE6OF01DRCMP.49.82.H05.1.454.CMB.1.raw
  modified_base (255)..(270): a, c, t, g, unknown or other
  misc_feature (255)..(270): n is a, c, g, or t
tcagagtcgagagacacgaccggtgctcgatttagtcgagctctctcgcgggcacgaccggtgctcgatttagctctacgctcagggcacgaccggtgctcgatttagagagagtgtgttggggttgggggaagaggaagactgaccggtccccccaggtagttcaggtgcgtgggcacagcggcccgtgggctgcctggtcaaggactacttcctctctcgactctgacggcgggctggacaaggcgacatagnnnnnnnnnnnnnnnn

SEQ ID NO: 168495 - DNA, 509 bp, Homo sapiens
  misc_feature: GYAE6OF01D407I.49.82.H05.1.454.CMB.1.raw
  modified_base (340)..(340): a, c, t, g, unknown or other
  misc_feature (340)..(340): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcggccctcaggggtctctgatcgcttcnctgctccacgtctggcagcacggcctccctgacaatctctcggctccaggcgtggggacgaggctgattattattgctgttcatatgcgtgatagtggacgaagggtgtcgggcggagggacgaaaggtgaccgtcgtaggtcacgcccaaggcctgccccctggtacc

SEQ ID NO: 168496 - DNA, 588 bp, Homo sapiens
  misc_feature: GYAE6OF01D3QC7.49.82.H05.1.454.CMB.1.raw
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactagaaaccagcagtgatgttagggaattataaccttttctctagtaccaacaacaccaggacaaacgccccaaactcatctatttangacggccgatcgacgccggccctcgacgggtctcgtgactcgcttctctcggtcctccgacgtcgtcggcacgccgaccggtccctccctagacctaacgttcctcggtcggcctccgagggccggtacggggacgaggtcgttagtaatttagttagttcgtcttgttactagttagtcggtacgtgtataggtcggacggtagggtcggtcgggacgggacggacgtagggtagacccggtcgtacggcacggacccgaaggtcctccggtccccgtcggtacc

SEQ ID NO: 168497 - DNA, 683 bp, Homo sapiens
  misc_feature: GYAE6OF01BIXCA.49.82.H05.1.454.CMB.1.raw
  modified_base (318)..(318): a, c, t, g, unknown or other
  misc_feature (318)..(318): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgagttggttagggtaaactttattaaccttttctcctacggtaaccaaacaaccaccaggacaaaccgaccccaactcatactatttanggacgcgtactcgacgaccggtcctcgacgggtctcgtcgactcgtcttctcgtcgcctccgtacgtcgtcggtacacggcctacccggtccttcccgtacgtaactacgttccgttccgtcgggtccctacccggagggtcggtacgggggacgacggtcgttaagtactttagtttacttcgtacgtttcttacgtacgttagttccgggccggttagtacggttacgggtcgggtacggggttaacggggttcggtaccgggggacggggtaaaccgggaacggtaacgggtaccgttaaccggtcgtacggtacccgacggtaccggaccggtcccggtccccgtcccggtcgtaccccgg

SEQ ID NO: 168498 - DNA, 644 bp, Homo sapiens
  misc_feature: GYAE6OF01B30QN.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatgttggaattataaccttttctcctggtaccaacaacacccaggacaaacgcccccaaactcatcatttatgacggccgatcgacgccggccctgacggggtctcgtgactcgtcttctctcggctccgacgtctggcacgcaccggccctccgtcgactaatccgtcgcgggtctcccgaggtcgtaggggacgagggtctgtaatttattagttacgtcttcgttactagtacgttggtccgggttagtaggtaggtcgggaccgggttaaggggttcggtttacccggggccgggtaacggggtaacccgtaagggttacccggtaacccggttaccggttaacggtacccgaaccgggtaccccgaacgggtcccttaccccgggtccccccgttccgggttaacccg

SEQ ID NO: 168499 - DNA, 750 bp, Homo sapiens
  misc_feature: GYAE6OF01BP5KT.49.82.H05.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (305)..(305): a, c, t, g, unknown or other
  misc_feature (305)..(305): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacngtcgatcaccatctcctgcactacgaaccngcagtgattgtaggtaattattacctttctctgtaccaacaaccaccgagaccaaacgacccccaaactcatctatttanggacggcgatcgacggccgccctggagggttctcgtcgacttccgtcttacgtcgtccggtcctacccgtacgtcgtcggactaccggccgtacccggtcccgttccctaagtaacccttaacgtccgttccggtacgggtaccctacccgggtacgggtacggggttaaccgggggacggtaccgggttcgttaaggttaacgtttttaacgttagtttccgttacgtttcgttaactaagttcggtacggtcggttaaggtacggttagggtaccgggaccggggttaagggttcggggttacggggaaaccggggtaagggttaaccgggtaaaccggggttcccggtaccccggtttaaccgggtaacgggtcccccgaaacgggtaaccccggtaccgggtacccgttcccccgggtcccccggtttaccggtaaccccg

SEQ ID NO: 168500 - DNA, 713 bp, Homo sapiens
  misc_feature: GYAE6OF01DQNRJ.49.82.H05.1.454.CMB.1.raw
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatctcctgcactgaaaccngcagtgatgttggaattattaacctttctccgtgtaaccaacaaccaccgaggaccaaacgacccccaaactcacttanactttagtgacggaccgtataccgacggccggtaccctaccggtagggtcctacgtgacttccgtctttccttacgtcggtcctccgtaccgtcgtcggtcgacgccgaccgtccctcctacgactaactcctcgtcgggtacctccgaggcggtacggggacgtcggtacttgtatttagttagtttcggtcttacgtttctaaacgttgttaccgggtacggttagtaaggttacgggtacgggtaccggggttaaggggttaccgggtttccggggaacgggtaacggggaaacggttaaaacggggtcccggttaaccggttaccccgggtaggttaccccggaaacggtacccggtaaacggtccccggttaaaccccgggtccccccgttccgggttaaccccg

SEQ ID NO: 168501 - DNA, 701 bp, Homo sapiens
  misc_feature: GYAE6OF01C1F4F.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacgaggtcctggcccagtctcgccctgactcagcctgcctccgtgtcgtgggtcctccgtggacagtcgatccaccatcctcctcgacactacgaaaccagcgagtgagtggttaggaaatttaacttaccctttctccgtacgtaaccaacaaccaccgagaaccaaaccgacccccaaactactactactaattacgtagaccggaccgtacgtacgacgcccggtacccgtacggtacgggtccgtcgtagtaccgttcgtccttccgtcggtccgtcctaccgtacgtcgtcgcgacgccgaccgtccctccgtacaacgtacgtcctcggtcggtaccgtccgacgggtacggtacgggacgtcggtctagttaattatttcgtctcgtttatacgtaagttcggtcggtacggtgtaagtacgggtaccggtacgggttaaggggttccggttacggggacggtaagggtaaccggtaaacgggttccggaccggttacgtacccgggtacgaacccggtacccgtaacggtcccgacccccgttccccgggtccgtacccg

SEQ ID NO: 168502 - DNA, 209 bp, Homo sapiens
  misc_feature: GYAE6OF01B9J90.49.82.H05.1.454.CMB.1.raw
  modified_base (198)..(198): a, c, t, g, unknown or other
  misc_feature (198)..(198): n is a, c, g, or t
  modified_base (203)..(209): a, c, t, g, unknown or other
  misc_feature (203)..(209): n is a, c, g, or t
tcagagtcgagagacacgaccggtgctcgatttagtcgagctctctcgcgggcacgaccggtgctcgatttagtcgagctctctcgcgggcacgaccggtgctcgatttagtcacgcgagaaagggaagggggctggccctgacgtgtttctcgttcccaccctcctctctctcgactctgagcgggctggcaaggcnatagnnnnnnn

SEQ ID NO: 168503 - DNA, 667 bp, Homo sapiens
  misc_feature: GYAE6OF01DE5B9.49.82.H05.1.454.CMB.1.raw
  modified_base (231)..(231): a, c, t, g, unknown or other
  misc_feature (231)..(231): n is a, c, g, or t
  modified_base (420)..(420): a, c, t, g, unknown or other
  misc_feature (420)..(420): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtcgtgggtctccgtggacagtcgatccaccatcctcctgccaactacgaaaccngctagtgagttggttaggtaactttaacttaaccttttcctccgtcgtaaccaaaccaaccaccgaggaccaaaccgaccccaaactcactactattagtagacggaccacgtcgacggccgtacccgtacgggtacggtcctacgtgtactccgttcttccgtcgtccgtctccgtacgtcgtcgccncgccgacccgtcctcgtacactactccggtcggtacgccgtacgcggtacgggtacgggacgtacggtcttagtatttagttacgtgttcgttattacgtacgttacggtccggtacggtaggtacggtacgggtacgggtacggggttaagggtcgggtaccgggacgggtacgacgggtacggtccgtaccggtacgacggtacgaccggtacgaccgtcccgtaccccgccggttaccgtcccg

SEQ ID NO: 168504 - DNA, 706 bp, Homo sapiens
  misc_feature: GYAE6OF01E41KN.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactgaaaccagcagtgatggttaggtaattactaaccttttctcctacggtaaccaacaaccaccacggacaaaccgacccccaaactcatactatttagtcgacggccgatcgacggccggtccctcggacggggttcctcgtgtacttcgtcttctcgtcggcctacctacgtcgtcggcacgccgaccggtccctcccgtacgaactaacgttctccgtcgggtccctaccggacgggtcggtacgggggaaccgacgggtccttagttaattttattacgttcgtacttggttactagttacgtcggtaccggtagtacgttagggtaccgggtaccgggtaaggggttcgggttaccggggaacggggaacggggtaaaccggtaaacggggttcccggtaaacccgggttccggttaacgggtacccgaacccggtaccccggtaacgggtccccgtccccggttcccccccggtggttaccccg

SEQ ID NO: 168505 - DNA, 598 bp, Homo sapiens
  misc_feature: GYAE6OF01EL0IG.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacaccaggcaaacgcccccaaactcatcatttatgaggccgatcagcgccctgagggtctctgatcgcttctcgtggctccacgtctggcagcacggcctcctgacatctctcggctcgaggcgtggggacgaggcttagatttattacttgcttgttacagttacgtggtaccggttagtagttggtacgggaccggtaagggggttcggtttaccggggacgggtaacggggaaccggtaacgggttacggtaacccggttccggttaacgggtccgaaacccggtccccggaaagggtcccttacccggtccccccgttgggttacccc

SEQ ID NO: 168506 - DNA, 192 bp, Homo sapiens
  misc_feature: GYAE6OF01DTI3R.49.82.H05.1.454.CMB.1.raw
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (185)..(192): a, c, t, g, unknown or other
  misc_feature (185)..(192): n is a, c, g, or t
tcagagtcgagagacacgaccggtgctcgatttagtcgagctctctcgcgggcacgaccggtgctcgatttagtcgagctctctcgcgggcacgaccggtgctcgatttagcgagctctctcggcgggcacggaccggtgctcgattttagcgagctctcgnggcgggctggcaaggcncaatgnnnnnnnn

SEQ ID NO: 168507 - DNA, 167 bp, Homo sapiens
  misc_feature: GYAE6OF01DOCJQ.49.82.H05.1.454.CMB.1.raw
  modified_base (166)..(167): a, c, t, g, unknown or other
  misc_feature (166)..(167): n is a, c, g, or t
tcagagtcgagagacacgaccggtgctcgatttagtcgagctctctcgcgggcacgaccggtgctcgatttagtcacgcgagaaagggaaaggggctggccctgacgtgtttctcgttcccgccctcctctctctcgactctgagcgggctggcaaggcgcatagnn

SEQ ID NO: 168508 - DNA, 686 bp, Homo sapiens
  misc_feature: GYAE6OF01BWF8F.49.82.H05.1.454.CMB.1.raw
  modified_base (199)..(199): a, c, t, g, unknown or other
  misc_feature (199)..(199): n is a, c, g, or t
  modified_base (329)..(329): a, c, t, g, unknown or other
  misc_feature (329)..(329): n is a, c, g, or t
  modified_base (429)..(429): a, c, t, g, unknown or other
  misc_feature (429)..(429): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctcgccctgactcacgcctcgcctccgtgtctgggtctcctggacngtcgatcaccatctcctgcactacgaaaccagctagtgagttggttaggtaaactttacttaacctttctctacgtaaccaacaaccaccgaggaccaaacgaccccaactcatctattatagacgccancgacgccgcctcgacgggttctcgtgactcgtcttcgtcgtcgtcctccacgtcgtcgcacgccgaccgccctcctagactactcgtacgcggtcgtcgngggtaccggtggggacgtacggtcgtttagttaacgtttatttacgttcggttacgttttacgtaccttaggttaacgtccgggttaccgtaggtacggttaacggggtcgggacgggttaaggggttccgggttagggggacccgggtaacgggtacccggtaaaggggttacccggaacccggttaccgggtcgggtaacccaccgggtaaccggtaccgggtccccttaacccggtcccccgtccggttacccg

SEQ ID NO: 168509 - DNA, 654 bp, Homo sapiens
  misc_feature: GYAE6OF01EO5FQ.49.82.H05.1.454.CMB.1.raw
  modified_base (307)..(307): a, c, t, g, unknown or other
  misc_feature (307)..(307): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatggttaggaatttataaccttttctcctacggtaaccaacaacaccagacaaacgcccccaaatcatctatttangaggccatcgacgccgccctcgacgggtctctgactcgtcttctcgtcgcctccgtacgtctcggacacgccgaccgtccctcccgtagaacctacgttccgtcgtcgggcctccgacgggtcgtaggggacgacgggtctagttatttagttagttcgtcgttgttacagttacggtcggtccgggttagtaacgttacgggtcgggtaccggttaagggggttcgtacgggggacgggaacgggtaacggtaaaccgggttcggtaacccggttaccggttacggtaccgaaccgggtaccccgtaacgggtccccttccccggtcccccggttcggttaccccg

SEQ ID NO: 168510 - DNA, 319 bp, Homo sapiens
  misc_feature: GYAE6OF01CVG8U.49.82.H05.1.454.CMB.1.raw
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (309)..(319): a, c, t, g, unknown or other
  misc_feature (309)..(319): n is a, c, g, or t
tcagagtcgagagacacgaccggtgctcgatttagtcgagctctctcgcgggcacgaccggtgctcgatttagtcgagctctctcggcgggcacgaccggtgctcgactttagtcgagcgtctcttcggtcgggcacggaccggtcgcgtcggtacctttaggagtagagtgtcgttgggttggggaacaggagacctggacggtcccccgaggtgttcaggtcgctgggcacagcggccctgggctcggcctggtacaagggctacttcctcgtctcgacctntgagcgggctggcaaggcncatagnnnnnnnnnnn

SEQ ID NO: 168511 - DNA, 643 bp, Homo sapiens
  misc_feature: GYAE6OF01B3M0Q.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactagaaaccagcagtgatggttaggaattattaaccgttttctcctggtaaccaacaacaccagacaaacgcccccaaaactcatcatttatgaggccgatcgagccgccctcgaggggtctcgtgactcgtcttctcgtcggtcctccctacgtcgtggtcacgccgaccggcctcccgtagaactaactctcgtcgggctccgaggtcggtaggggacgaggtctaggtaatttacgttaagttgtcttgttcaatacgtggtccggttagtagttaggtagggaccggtaaggggttcgggttaccgggacggggaacgggtaacccggaaaggggttacgtaacccgggttaccggtaacgggttaccaaccggtacccgtaaacgggtcccgttaccccggtccccccgttgggttaacccccg

SEQ ID NO: 168512 - DNA, 752 bp, Homo sapiens
  misc_feature: GYAE6OF01A0CAZ.49.82.H05.1.454.CMB.1.raw
  modified_base (230)..(230): a, c, t, g, unknown or other
  misc_feature (230)..(230): n is a, c, g, or t
  modified_base (608)..(608): a, c, t, g, unknown or other
  misc_feature (608)..(608): n is a, c, g, or t
tcagagtcgagagacacgaccggtgctcgatttagtcgagctctctcgcgggggggtcacaagaggcagcgctctcgggacgtctccaccatggcctggctctgctgctcctcactctcctcactcaggacacagggtcctgggcccagtctgccctgactcagcctgcctccgtgtctgggtctcctggtacagtcgatccacctatcctcctgacactacgaaaaccngacagtcgagttggttagggaatttacttaacccttttctaccttacggtaaccaacaaaccacccaacggaccaaaaccgtacccccaaatccagtacctaatttacgacgtacggcccgtaatccgtaacggccggtacccgttcgaacggggttcctcgtacgacgtccgttcttcctctcggcttcccgtacgtccgtacggctacgccgtaacccggccttccccgagtacctaacgttctccgtacggggtccctacccgtacggggtaccggttacgggggaccggtacggggttactacgggttaacttttaagtttacggtttcgttacgttacgttacgttaacgtaacgttcggtacccggggttanaacggtttacgggttacgggtacgggttaaacggggtttcggtaccggggtagggaaaccgggtaacgtaagggtacccggtacgttccgaagggttccaaccggtacccgtaagggtcccctaccggtccccgtacggttccc

SEQ ID NO: 168513 - DNA, 709 bp, Homo sapiens
  misc_feature: GYAE6OF01AIIYX.49.82.H05.1.454.CMB.1.raw
  modified_base (233)..(233): a, c, t, g, unknown or other
  misc_feature (233)..(233): n is a, c, g, or t
  modified_base (470)..(470): a, c, t, g, unknown or other
  misc_feature (470)..(470): n is a, c, g, or t
  modified_base (509)..(509): a, c, t, g, unknown or other
  misc_feature (509)..(509): n is a, c, g, or t
  modified_base (547)..(547): a, c, t, g, unknown or other
  misc_feature (547)..(547): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggccccagtctcgccctgactcagcctcgcctccgtgtcgtgggtctcctggacagtcgatccaccattcctcctgcactacgaaaccngcagtgtagttggttaggtaatttacttaaccttttctccgtacgtaaccaaacaaccaacccgaggaccaaaacccgaccccctaaactccaattacctaatttagtacgacggaccacgtccacggtcccgaccctggtacgggtccttcgtagtactccgtcttccgtcgtccgccttcccgtacggtcgtcggcgtacgaccgtcccggtcccttaccggtacaacgttaccnccgttacggcggtcccgtacgcggcgggtacggggacgnggtccttaggttactttagttgttacgctttgtaactnttaacggtcggtacgtagtaggtgggtaccgggtacgggtaacgggtcgggttacggggacgggtaacggaaacggtccggggtacggtaccccgttacggcggtaaaccccacggtacccggtacgtccccgtaccccggtcccccggttggttaaccccg

SEQ ID NO: 168514 - DNA, 635 bp, Homo sapiens
  misc_feature: GYAE6OF01DFE6D.49.82.H05.1.454.CMB.1.raw
  modified_base (231)..(231): a, c, t, g, unknown or other
  misc_feature (231)..(231): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
tcagagtcgagagacacgaccggtgctcgatttagtcgagctctctcgcggggggggtcacaagaggcagcgcgtctcgggacgtctccaccatggcctgggctctgactgcctcctcactctcctcacgtcaggacacagggtcctgggcccagtcctgccctgactcagcctgcctcgtgtctggtctcctggacagtcgactcgaccatctcctgccactgaaacccngcaaggtgagtcgttacggaacttacgtaccttttcctccgtcggttaaccaaacgaacacccaggaccaaacgccccaaactcatctattagtgagccgatcagccgtcctacgacgggtctacgtgactcgtcgttcgtcgtcgctcgacgtctacggcgacgccacggtcctacctgaacagtctcgtggcctcgaggcgtagggaccaggcttagtattnttagttcgcttnttcaatagtcggtaccgtgtagtacgtcggtacgtagggttccgttaggggaccggtaagggaacgtaaaacggggtaccgttacccggttaccgttaacgggtaccgtaaccggtaccccgtaaaacgggtccctttaacccgggccccccgttacgggttaacccc

SEQ ID NO: 168515 - DNA, 658 bp, Homo sapiens
  misc_feature: GYAE6OF01AONBF.49.82.H05.1.454.CMB.1.raw
  modified_base (297)..(297): a, c, t, g, unknown or other
  misc_feature (297)..(297): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatggttggaattataacctttctctgtaccaacaacaccagacaaacgccccaaactcatcattangaggcgatcgacgcggccctcgaggggtctcgtgatcgtcttctcgtcggcctccacgtcgtcggctacgccgaccggtcccttccctcgaacctaacgtccgtcgtcgggcctccggaggtcggtaggggacgtacgggcgttagtatttagttacgttgtctttagttcgaacttacggtcggtaccgggttagtaacgttacgggtacggggtaccgggttaagggggttcgggttacggggaaccgggggaagggggtaaaccggtaaaaggggttccggtaacccgggttcgttaacgggtccgaacgggtacccggaacgggtcccgtcccggtccccccgttcgggttaacccg

SEQ ID NO: 168516 - DNA, 118 bp, Homo sapiens
  misc_feature: GYAE6OF01CCCIJ.49.82.H05.1.454.CMB.1.raw
  modified_base (107)..(118): a, c, t, g, unknown or other
  misc_feature (107)..(118): n is a, c, g, or t
tcagagtcgagagacacgaccggtgctcgatttagtcgagctctctcgcgggcacgaccggtgctcgatttagtcgagctctctagcgggctggcaaggcgcatagnnnnnnnnnnnn

SEQ ID NO: 168517 - DNA, 153 bp, Homo sapiens
  misc_feature: GYAE6OF01AP7BX.49.82.H05.1.454.CMB.1.raw
  modified_base (120)..(120): a, c, t, g, unknown or other
  misc_feature (120)..(120): n is a, c, g, or t
  modified_base (136)..(136): a, c, t, g, unknown or other
  misc_feature (136)..(136): n is a, c, g, or t
  modified_base (142)..(153): a, c, t, g, unknown or other
  misc_feature (142)..(153): n is a, c, g, or t
tcagagtcgagagacacgaccggtgctcgatttagtcgagctctctcgcgggcacgaccggtgctcatttagtcgagctctctcgcgggcacgaccggtgctcgatttagcgagctctcngcgggctggcaaggcncatagnnnnnnnnnnnn

SEQ ID NO: 168518 - DNA, 581 bp, Homo sapiens
  misc_feature: GYAE6OF01BW3JJ.49.82.H05.1.454.CMB.1.raw
  modified_base (224)..(224): a, c, t, g, unknown or other
  misc_feature (224)..(224): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattattaaccttttctcctggtaccaacaacaccaggacaaacgcccccaaactcatcatttatgaggccgatcgacgccggccctcgaggggtctctgacttcgcttctctggcctccgtacgtctcggcacgcgaccggcctcctagacatcgtcgtgggtcctccgagcgtaggaggaccgnggtctgtatttactcngccagctacataactaacaaactaattaaccgtacgtttcgggtacggttccgggacgggacccgggtaacgtaaccgtccggtacccgttcccggtacgccgacggacccgtaggcccgtcccgcccccggttccggtccc

SEQ ID NO: 168519 - DNA, 655 bp, Homo sapiens
  misc_feature: GYAE6OF01BM8BA.49.82.H05.1.454.CMB.1.raw
  modified_base (224)..(224): a, c, t, g, unknown or other
  misc_feature (224)..(224): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtaggaattatacctttctctgaccaacaacaccagacaacgccccaaactcatctaattancgaggcgatcgacgcgccctcgagggtcctcgngatcgcttctcgtcggcctaccgtacgtcgtggccacgccgaccggcccttaccgtacgtaacaacttcgtacggtcgggtaccctacggacgggtaccggtaggggaccgtaggtccgttagtaacgttttagttacgtttcgtacgttacgttacgtaattacggttcggtaccgggtaggttaacgttacggggtacgggtaccgggtaagggttcgggttacgggacgggtaagggaacccgtaggggtaccgtacccggtcgtaacgggtaccgaaccggtcccggtaaacggccccgttcccggcccccgggttgtaccccg

SEQ ID NO: 168520 - DNA, 678 bp, Homo sapiens
  misc_feature: GYAE6OF01EIAYN.49.82.H05.1.454.CMB.1.raw
tcagagtcgagagacacgaccggtgctcgatttagtcgagctctctcgcggggggggtcacaagaggcagcgctctcgggacgtctccaccatggcatgggctctgctgctcctcactctcctcactcaggacacagggtcctgggcccagtctgccctgactcagcctgcctccgtgtctgggtctcctggacagtcgatcaccatcctcctgccaactcgaaaacccagcaggttgagttggttagggtaattacttaaccttttctccgtcggtaaccaacaaccacccaggaccaaacgacccccaaactcactactatttagtgacggaccgatcgagccggcctcgacgggtctcgtgactcgtcttcgtccgtcggcctccgacgtcgtcgcgacgcgtaccggtccctccgtacgactactcgtacgtcgggtcctcggacggcggtacgggacggtcggtacgttgttaactttatttacgtttcggttcttggttactacgttaacggttcggtaccgggttaggtacgttacgggtacggggtacgggtaacggggttcggtacggggtacccgggtaacgggtaccggtaagggtaccggtacccggttacggtacggtacccgtaaccgggacccgaacggtccgtccccgggtccccgtccggg

SEQ ID NO: 168521 - DNA, 760 bp, Homo sapiens
  misc_feature: GYAE6OF01BY52O.49.82.H05.1.454.CMB.1.raw
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccattcctcctgcactagaaaccngcagtgattggttaggtaatttacttaaccttttctaccgtacgtaaccaaccaaccaccgagaccaaaccgacccccaatcactcaatttanggacgcctatcgacgcccggccctcggacgggttctcgtcgtacgtcgtctttctcgtcggtcctccgtacgtcgacggtccacgtacccgaccggtcccgtaccctacgtaacctaacgtccgtcgtacgggtccctcggtacgggtcgggtacggggaccggtaggtaccgttaaggttacttttaagttacgtttacgtacgtttacgttactaacgtttaacggtccgggttacgggttacgttaaacgggttaacggttaccgggggtaaccgggttaacgggggtttcgggttaccggggggtacccggggtaaccggggttaaccgggtaaacggggttcccggtaacccgggttaccgggttacggtaaccccggaccggtaccccggtaaacgggtcccgtccccggttacccccggttcggttaacccccg

SEQ ID NO: 168522 - DNA, 672 bp, Homo sapiens
  misc_feature: GYAE6OF01EO8T5.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattattaacctttctctgtaccaacaacaccaggacaaacgacccccaaactcatctatttatgacggccgatcgacgccggtcccgtcgacggggtctcgtcgtagtccgtcttctcgtcggacctcccgtacgtcgtcggccacgtccgaccggccctccccgtagaacgtaacttccgtcgtcgggccttccggacgggtcgggtacggggacgacgggtcgttaggtaatttactttagttcgtcgtttcgttactagttacgtcggtccgggttagtaacggttagggtacgggaccgggttaaggggttgggttacccggggacggggtaacggggtaaccgtaaggggttccgtaacccggttccggtacgggtaccgaccggtaccggaaccggttccgtaccccggtcccccgtcggtaccccg

SEQ ID NO: 168523 - DNA, 645 bp, Homo sapiens
  misc_feature: GYAE6OF01D0AB7.49.82.H05.1.454.CMB.1.raw
  modified_base (209)..(209): a, c, t, g, unknown or other
  misc_feature (209)..(209): n is a, c, g, or t
  modified_base (590)..(590): a, c, t, g, unknown or other
  misc_feature (590)..(590): n is a, c, g, or t
tcagagtcgagagacacgaccggtgctcgatttagtcgagctctctcgcggggggggtcacaagaggcagcgctctcgggacgtctccaccatggcctggctctgctgctcctcactctcctcactcaggacacgagggtcctgggcccagtctgccctgactcacgcctcgcctccgtgtcgtgggtctccgtgacagtcgatcaccntctcctgctacgtacgaaaccagactagtgtagttggttaggtaatttacttaaccttttctaccgtacgtaaccaaacaaccaccgtacggaaccaaaccgaaccccctaaactacactacttaattacgtacgacggacctagtacgacgcccgcccgtacggtacggtctcgtacgtactcgtcttctcgtacggtctaccgtacgtcgtcgacgcgtaccgaccgcctccgaacgactactcgtcgtcggtcctacggacggtcgggacgggacggtagtacttgtatttagttatcgtattcgtactagtagccggtagtagtacgtacggtcggacgggtacggttgggacgggacggaaggtaacggtacgggngtaccggttagcgtaaccggaccgtacgtacgacccgtccgtcccgtccgtaccg

SEQ ID NO: 168524 - DNA, 782 bp, Homo sapiens
  misc_feature: GYAE6OF01DXK1Z.49.82.H05.1.454.CMB.1.raw
  modified_base (430)..(430): a, c, t, g, unknown or other
  misc_feature (430)..(430): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcacctatcctcctgccacgtagaaacccagcagtgagttgttcggaatttactaaccttttctccgtaggtaacccaacaaccaccgaggaccaaacgacccccaactacatctattagtcggacggtccgatcgacgccggtcccgtcgacgggtctctgtactcgtcttctcgtcgtcctaccgtcgtcgtcggactacgtacccgtaccggtccctaccccgtanaaccgttaacgtccccgttcggtacgggcccgttacccgacggggtaccgggttaacgggggacccggtaggggtccgtttaagttacgtttttaagtttacgtttacggtcgttttacggtttcgtaacgttacggtcgggttacccggggttagtaagggtttaaccgggtccggggtaaccggggttaacggggttcgggttaacccggggggtacgggtaaacggggggtacggttaaaaaccggggttcgttacccccggggttaacccggttacggggttaacccaccgggtacccggtaacgggtcccctaccccgggtcccccccggttacgggttaacccccg

SEQ ID NO: 168525 - DNA, 789 bp, Homo sapiens
  misc_feature: GYAE6OF01B4D13.49.82.H05.1.454.CMB.1.raw
  modified_base (283)..(283): a, c, t, g, unknown or other
  misc_feature (283)..(283): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgcccctgactcagcctgcctccgtgtctgggtctcctggacagtcgatcaccatctcctgcactgaaaccagcagtgatggttggaattataaccttttctcctggtaccaacaacaccaggacaaacncccccaaatcatcatttaatgaggccgatcaacgccggcccgtcacgggggttacctctgacgttcgacgtttctccgtcggctaccccgacggttactgggcccaggtacccaccgggtcccttccccgtacggtaaccaaacgttccgttcctacggggtccctaccccgggtacgggtacccgttagggggggaacccgtaggggtcccgtttccggtaaagtttttaaacgtttaagtttccgttaccggtttacggtttacgtaacctttaaggttcgggtcccggggttacgaagttttaccgggacgggggttaaccgggtaaacgggggtttccggttaccgggggtacccggggtaaacgggggaacccggttaaaccggggttccggtaacccccggggtttccggtttaccgggtaaccccgttaacccgggtacccccggaaaacggggttcccttcccgggtcccccccccgggtttggttaaaccccccggg

SEQ ID NO: 168526 - DNA, 754 bp, Homo sapiens
  misc_feature: GYAE6OF01BE47S.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctcgccctgactcacgcctgcctccgtgtcgtgggtctccgtggacagtcgatccaccatctcctgaccacgtacgaaaccagcagtgtagtggttaggtaatttacttaaccttttctaccgtacgtaaccaacaaccaccgacgaaccaaaccgaccccctaactcatactattagcgacgaccgatacgacggcccgtaccgtacggtacggttctcgtacgtacgtccgtccttcgttcgtcgtacctccgtaccggtccgtacggccgtacggcccgacccggtcccttaccgtaaccgtactaccgttccgttccgggtccggtcccgtaccggtagggaccgggtacgggacggtacggtagttacggttacttttaagtcgtttcggttacttacgttacgtcgttacggttacgggtcgggttagtacggttagggtacccggggtacggggttacggggttccgggtaacggggtaaccgggtaaggggttaaaccggtaacggttacccggttaacccggtcggtaccgggtaacccgacgggtacccgggtaccgtacccgtcccgggtccccccgttaggttaccccg

SEQ ID NO: 168527 - DNA, 712 bp, Homo sapiens
  misc_feature: GYAE6OF01AO644.49.82.H05.1.454.CMB.1.raw
  modified_base (226)..(226): a, c, t, g, unknown or other
  misc_feature (226)..(226): n is a, c, g, or t
  modified_base (335)..(335): a, c, t, g, unknown or other
  misc_feature (335)..(335): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactacgaaaccngcagtgagttggttagggtaatttacttaacccttttctccgtggtaaccaaactaaccaccctaggacctaaaaccgcccccctaaaactccaacttcgtaatttacngtacggccgaagtcgaacgtccggccctcgacgggttctcgtgtacttccgtacttctcgtacggcctaccgtacggtcgtcggccgtaacgccgaccgtcccttcccgttacgaacctaacttccgtccggttcggtacccttaccggacgggtcgtcgggggacgacgggtcgttaggttactttagttagttcgctttcgttactagttacgtaggtcccggtagtacgttacggttcgggaccgggttaaggggttcggtaccgggtacgggaaggggtaaccgtaaacgggttcgtacccgggttacccgtaaggtacccgaccggtacccgtaacgggtccccgtcccggtcccccggtacggttaccccg

SEQ ID NO: 168528 - DNA, 678 bp, Homo sapiens
  misc_feature: GYAE6OF01A9A4Q.49.82.H05.1.454.CMB.1.raw
  modified_base (421)..(421): a, c, t, g, unknown or other
  misc_feature (421)..(421): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttgggaatttataaccttttctcctggtaccaacaacacccaggcaaacgcccccaaactcatcatttatgagccgatcaggcgccctcgaggggtctctgactcggtcttctctcggctcccacgtctggactgcaccggtccctcctgactatcgtcgtgggcctacgaggtcgtaggggaccgngggccttaggtaatttacgttagtttcgtacgtttcgttaccaagttacgttcgggtacccggtgtaacgttcgggtcgggacccgggtaaaggggggtttcggtttaccgggggacccgggtaaaggggggtaaacccgtaaaacggggggttacccggtaaccccggggtttaccgtacggggttacccgaccgggtaaccccggaacggggtacccgttccccgggtaccccccccgttggggtttaccccccg

SEQ ID NO: 168529 - DNA, 696 bp, Homo sapiens
  misc_feature: GYAE6OF01A8FMV.49.82.H05.1.454.CMB.1.raw
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
  modified_base (482)..(482): a, c, t, g, unknown or other
  misc_feature (482)..(482): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcgatcaccatctcctgcactgaaaccngcagtgagttggttagggtaaatttacttaaccttttctccgtaggttaacccaaaccaaccacccgaggaccaaaccgacccccaaactcatctatttangacggccgtatcacgccgtccctcgacgggtctctgatcgtcttctcgtcggacctccgtacggtcgtcggacacgaccgtaccggtccccttccctacgtaacctaacttccgttcgtacgggcctacccggtagggtacgggtacggggaaccgngggtaccttagtaacttttacgtttacgttcgtcgtttacgttactagttacgttccggtaccgggttagtaacggttcggtacggggtaccgggttaggggttcgggtaccggggacgggtaaggggaaccgttaacgggtccggtaacccggttccggtacgggtacccacggtacccggtacggcccgtccggtcccccgttggtaccccg

SEQ ID NO: 168530 - DNA, 712 bp, Homo sapiens
  misc_feature: GYAE6OF01AFL9F.49.82.H05.1.454.CMB.1.raw
  modified_base (323)..(323): a, c, t, g, unknown or other
  misc_feature (323)..(323): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatcctcccgcactagaaaccagcagtgattggttgggtaatttacttaaccttttcctccgtggtaaccaacaaaccaccccaggaccaaacgccccccaaactcactctatttacngacggcgatcgacgccggcccctcggacgggtctgtacgtcgttcgtcctttcgtccgtggtcctccgtacgtccgtcggccgacgtccgaccggtcccttccccgtgaaccctaacttccgttccggtacggggtccccgtaccccggtacgggtacgggttccgggggaaacgtcgggccgttagtttaaacttttaacgttgtttgtccgtttgttaccgtaacttcgtacggtcggtacggtaaggtacgggttgggtacccgggttagggtcgggtttacgggccgggtaaacgggaccggtagggtcccgtaacccggttccggtacggtacccgaccggtacccgaccggtcccggtccgccccccggttgtacccctcccg

SEQ ID NO: 168531 - DNA, 229 bp, Homo sapiens
  misc_feature: GYAE6OF01DLWLV.49.82.H05.1.454.CMB.1.raw
  modified_base (214)..(229): a, c, t, g, unknown or other
  misc_feature (214)..(229): n is a, c, g, or t
tcagagtcgagagacacgaccggtgctcgatttagtcgagctctctcgcgggcacgaccggtgctcgatttagagagagtgtggttggggtttgggggaagaggaagactgacggtccccccaggagttcaggtgctgggcacagcggccctgggctgcctggtcaaggactacttcctctctcgactctgagcgggctggcaaggcgcatagnnnnnnnnnnnnnnnn

SEQ ID NO: 168532 - DNA, 111 bp, Homo sapiens
  misc_feature: GYAE6OF01ATT91.49.82.H05.1.454.CMB.1.raw
  modified_base (106)..(111): a, c, t, g, unknown or other
  misc_feature (106)..(111): n is a, c, g, or t
tcagagtcgagagacacgaccggtgctcgatttagtcgagctctctcgcgggcacgaccggtgctcgatttagtcgagctctctgcgggctggcaaggcgcatagnnnnnn

SEQ ID NO: 168533 - DNA, 214 bp, Homo sapiens; identical to SEQ ID NO: 168257
  misc_feature: GYAE6OF01A6N1G.49.82.H05.1.454.CMB.1.raw
  modified_base (213)..(214): a, c, t, g, unknown or other
  misc_feature (213)..(214): n is a, c, g, or t

SEQ ID NO: 168534 - DNA, 205 bp, Homo sapiens
  misc_feature: GYAE6OF01A55XF.49.82.H05.1.454.CMB.1.raw
  modified_base (173)..(179): a, c, t, g, unknown or other
  misc_feature (173)..(179): n is a, c, g, or t
  modified_base (183)..(205): a, c, t, g, unknown or other
  misc_feature (183)..(205): n is a, c, g, or t
tcagagtcgagagacacgaccggtgctcgatttagtcgagctctctcgcgggcacgaccggtgctcgatttagtcacgcgaggaaagggaaaggggctggccctgacgtgtttctgttcccgccctcctctctcgtcgactctggagcgggactggacaaggcgtcaatcggnnnnnnntgcnnnnnnnnnnnnnnnnnnnnnnn

SEQ ID NO: 168535 - DNA, 715 bp, Homo sapiens
  misc_feature: GYAE6OF01EOYE0.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactgaaaccagcagtgatgttggaattataaccttttctctcgtaccaacaacaccacgacaaaccgccccaaactcatctattatgacggccgatcgacgccgcccgtgacggggttctcgtagactccggtctttcgtcctcggtcctccctacgtcgtcggaccagccgacccggtccctacccgtacgactacgttcctcgtcggtcctaccgacggtcgtacgggggaccgtaacgggtcgttaaggtattttaacgttagtttcggtaccttttcggttaccttaaagttacgggttccggttaccggggttagttacgggttaacgggttcggggaccggggtaaacggggtttcgggttaaccggggtaccgggggtaaccgggtaaccgggttaccggggtaccgggttaaccccgtttcccgggtacggttaccgacccgggtaaccgtaacccggttccgtcccccgggttaccccgtccgggttaccccg

SEQ ID NO: 168536 - DNA, 730 bp, Homo sapiens
  misc_feature: GYAE6OF01A4PLS.49.82.H05.1.454.CMB.1.raw
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacagtcgatcaccatcctccngcactgaaccngcagtgatggtaggaattatactttcnctgaccaacaacaccagacaacgccccaatcatcatttancgacggtccgatcgacgccggtcccctaggacgggtctctgtacgtcgtccttctcgtcggtctacccgtcgtacgttgggccacggccgacccggccccttacccgtacgtaaccgtacgtttccgttccggttcgggacccttcccggagggttcccgggtacgggggacgaacgggtcttacggttaaactttaacgttttcgttcggttacctttggtttaccgtaatttacggttacccgggtcggggttagttaaacggttgggttaccggggacccgggtttaagggggttccgggtttaaccgggggaccgggtaaacggggtacccgtaaacgggttccgggaacccggttttaccggtaacgggtacccgtaaccggtaccccggtaacggggtcccctaccgggtccccccgtttcggggtaaccccg

SEQ ID NO: 168537 - DNA, 210 bp, Homo sapiens
  misc_feature: GYAE6OF01DWDDE.49.82.H05.1.454.CMB.1.raw
  modified_base (177)..(177): a, c, t, g, unknown or other
  misc_feature (177)..(177): n is a, c, g, or t
  modified_base (199)..(210): a, c, t, g, unknown or other
  misc_feature (199)..(210): n is a, c, g, or t
tcagagtcgagagacacgaccggtgctcgatttagtcgagctctctcgcgggaccggtgctcgatttagtcgagcttctcgcgggcacgaccggtgctcgatttagtcacgcggagaaagggaagggggctggccctgacgtgtttctcgttcccgcctcctctctctcgactctgngcgggctggacaggcgcatagnnnnnnnnnnnn

SEQ ID NO: 168538 - DNA, 691 bp, Homo sapiens
  misc_feature: GYAE6OF01A6HA8.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcggggggggtcacaagaggcagcgctctcgggacgtctccaccatggcctggctctgctgctcctcactctcctcactcaggacacagggtcctgggcccagtctgccctgactcagcctgcctccgtgtcgtgggtctcctggacagtcgatcaccatctcctgcactagaaaccngcagtgattggtaggtaattactaaccttttctccttacggtaccaaacaaccacccgaaggaccaaaccgacccccaaaactcatactatttagtcgacggtaccgatcgacggccggccctacggtacggggtctcgtgactccgtctttctcgtcgcctacctacgtcgtgtccgagccgaccggtccctaccctacgaactactccgtcggtcggtcgtccgacgggtcgggagggtacggacgtacgttaggtaattttagtttagttacgtcgtttgttacgttagttaacgtccggtagggtagtaacggttgggtaccgggtaccgggttaaggggttcgggtaccggggtaccggggaacgggtacccggtaacggttaccgggtacccggttacgtaccgggaccgaacccgggtacccgacggtcccgtccccggttccccggcccggttacccg

SEQ ID NO: 168539 - DNA, 174 bp, Homo sapiens
  misc_feature: GYAE6OF01DVWK8.49.82.H05.1.454.CMB.1.raw
  modified_base (163)..(174): a, c, t, g, unknown or other
  misc_feature (163)..(174): n is a, c, g, or t
tcagagtcgagagacacgaccggtgctcgatttagtcgagctctctcgcggcacgaccggtgctcgatttagtcacgcgagaaagggaaggggctggccctgacgtgtttctgttcccaccctcctctctctcgactctgagcgggctggcaaggcgcatagnnnnnnnnnnnn

SEQ ID NO: 168540 - DNA, 659 bp, Homo sapiens
  misc_feature: GYAE6OF01CBP21.49.82.H05.1.454.CMB.1.raw
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
  modified_base (361)..(361): a, c, t, g, unknown or other
  misc_feature (361)..(361): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattataaccttttctcctggtaccaacaacaccaggacaacgcccccaaacncatcatttatgacgccgatcacgccggcctcgaggggtctctgactcgtcttctcgtcggctcctacgtntcggctacgccgaccggtccttcccgtagtactaacttccgttcgtcgggtccctacccgagggtcggttcgggggaccgtagggcttaggtaacgtttaagtttgtttacgcgtttcgttctaagttacgtcggtccgggttagtaacgttagggtacgggtaccggtaaggggttcggttccggggacgggtaacgggtaaccggtaaacgggttcggaacccggttccggtacgggtccgaaccggtacccgggtaaaccggtcccgttcccggtccccccgttcgggtaccccg

SEQ ID NO: 168541 - DNA, 765 bp, Homo sapiens
  misc_feature: GYAE6OF01D099B.49.82.H05.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagttctgccctgactcagcctgcctcgtgtctgggtctccgtggacagtcatcacntctcngcactgaaccngcagtagagttggttacggtaatttacttaccttttctacgtacgtaaccaaactaaccaccgaaggaccaaaccgaccccctaaatcactactagtttacgtaggaccggacctacgtcgacggtccggtacccgtacggtaacggggttcctacgtcggtaactccgttccttccgtacgttccggtccttaccgtaccggttccgtacggaccgacgtccggtaacccggtccccttaccgtacgtaacttaaccgttccgttccggtcggtaccgtacccggtagggtaccgggtacgggggtaccgtacgggtacgttacggttaaacttttacggtttacgtacgttaccgtttacgttagtaaccggttcgttcccgggtaggttacgtacggttacgggtaccgggtacgggttacgggttacgggtaccgggtaacgggtacgggtaaccggtaacggggttcctaccgggtacggtaccgtaccgacggacccggtaaccggtcccgtaaccccggtcccgttacggtaccccg

SEQ ID NO: 168542 - DNA, 747 bp, Homo sapiens
  misc_feature: GYAE6OF01ATPWL.49.82.H05.1.454.CMB.1.raw
  modified_base (235)..(235): a, c, t, g, unknown or other
  misc_feature (235)..(235): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtggacagtcgactcaccacttcctcctgctactacgaaaaccngcagtcgtagttggttaggtaaatttacgtaacccttttcctaccgtacggtaacccaaaccaaccaacccgacgaaccaaaccgtaccccctaaactacactactacgtttacgcggaacggccgtaagtaccgaaccggtccggtaccccgtacggtacggggttcctccgtacggtactccgtcttcgtcgtacgtcctacccgtcgtcgacggcacgccgtaccgtccctactacgactacgtcgtcgtacggtctcgtacgggcggtacgggacgtagcttagtagtttacttagttcgtcttacgttacgacttaggttcccggacgttaaggtacgttacggggtaccggggtacgggtaacggggttccgggtaaccggggtacggggtaaccgggtaaacggttaacggggttacccgtaaccggggttccggtaaccgggtaccgaaccgggtacccggtaacggtccccggttacccggtccccccgggttgttacccccg

SEQ ID NO: 168543 - DNA, 183 bp, Homo sapiens
  misc_feature: GYAE6OF01A3SXL.49.82.H05.1.454.CMB.1.raw
  modified_base (176)..(183): a, c, t, g, unknown or other
  misc_feature (176)..(183): n is a, c, g, or t
tcagagtcgagagacacgaccggtgctcgatttagtcgagctctctcgcggggctctctcgcgggcacgaccggtgctcgatttagtcacgcgagaaagggaaggggctggccctgacgtgtttctgttcccacctcctctctctcgactctgagcgggctggcaaggcgcatagnnnnnnnn

SEQ ID NO: 168544 - DNA, 664 bp, Homo sapiens
  misc_feature: GYAE6OF01BCBEY.49.82.H05.1.454.CMB.1.raw
  modified_base (227)..(227): a, c, t, g, unknown or other
  misc_feature (227)..(227): n is a, c, g, or t
  modified_base (307)..(307): a, c, t, g, unknown or other
  misc_feature (307)..(307): n is a, c, g, or t
  modified_base (455)..(455): a, c, t, g, unknown or other
  misc_feature (455)..(455): n is a, c, g, or t
  modified_base (641)..(641): a, c, t, g, unknown or other
  misc_feature (641)..(641): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccatctcctgcactagaaaccngcagtgattggtggaattattacctttctctacgtaacaacgaacaccgagacaaaccgaccccaaactcatctattagngacggcacgtcacgtccggcctacgacgggtctcgtagacgtcctcttctcgtacgtcctacgtacgtcgtcgcgcgacgaccggtccctccgtagaactacgtcctcggtaccgggtctacccgagggttaccggcgggggtaacgnggtaccttaaggtattttaagttcgttaggctttaacgttacctagttaacgttcggaccggtagtacggtagggttaccgggacggtaaggggtccgggttaggggaccgggtaaaccggggtacgtaaacggggtccggtaacccgggtcgtttacggaccgtacgggacccgtaaggtccccncccggttccccggtcggtacccg

SEQ ID NO: 168545 - DNA, 854 bp, Homo sapiens
  misc_feature: GYAE6OF01AO3T2.49.82.H05.1.454.CMB.1.raw
tcagagtcgagagacacgaccggtgctcgatttagtcgagctctctcgcggggggggtcacaagaggcagcgctctcgggacgtctccaccatggcctggctctgctgctcctcactctcctcactcaggacacgagggtcctgggcccagtcctgccctgactcagcctgcctccgtgtcgtgggtctccgtggacacgtcgtatccaccagtcctcctgaccactagaaaccagccagtgtacttggttaggtaatttaacttaaacccttttcctccgtacggtaaccctaaaccaaaccacccaacggaccaaaacccgacccccctaaaactaccgaacttcgtaacttttacgaggtacggtacccgaacgttccgaaccgtccggcccctacggtacggggttcctcgtacgtacttacgtccgttcttcggtacgtacctcccgtaaccgttccgtcggccgtaacgtcccgaccggtccccttacccgtacgaaccttaaccgtccggttaccgttccgggtacttccccggtaacggggttccgggttaacgggggacggtaacggtacccggtttaaccggtagtttttaaacgttcgttttacggtacctttacgtttaacgtaacgttacggttaccgggttacccgggttaaggttaacggttacggggttaccgggggtaacccgggtagggggtttaccgggttaccggggaacggggtaaacgggtaaaaccgggttaaccggggttacccgggtacccggttacccgttacgggttacccaaccgggtacccggtaacggcccgttacccccggttcccccgtacgggttaccccc

SEQ ID NO: 168546 - DNA, 738 bp, Homo sapiens
  misc_feature: GYAE6OF01D9CS0.49.82.H05.1.454.CMB.1.raw
  modified_base (226)..(226): a, c, t, g, unknown or other
  misc_feature (226)..(226): n is a, c, g, or t
  modified_base (521)..(521): a, c, t, g, unknown or other
  misc_feature (521)..(521): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatcctcctgcactacgaaaccngacaggtgagttggttagggtaatttacttaaccttttctccgtacgtaaccaaacaaccaccgaggaccaaaccgaccccctaaatacactctaatttagtacggacggccgtatccggacgtcccggacccgtcggtacgggttccttcgtacgtacgttccgtctttccgttcgtcgtcctaccctcgtaccgtggccacgcccgtaccggtcccctaccgtactaaccgttacttcccgtcgggttccgggtacccgtacccggtagggtccgggtaacgggggaaccggnggtacgtttaacgtagttttaacgttagttccgttacgtttcgttactaacggttacgtcgggtaccgttaggttaacggttaacggggtcgggtaacgggttacgggttcgggtacggggacgggtaaacggggtaacgtaacgggttaccgtaccgggtctacgggtacccgaaccgtacccggtacggtcccgtccggtccccgtcggtacccc

SEQ ID NO: 168547 - DNA, 851 bp, Homo sapiens
  misc_feature: GYAE6OF01EMX8D.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctccctcactctcctcactcaggacacgagggtcctgggcccagtctcgccctgactcagcctcgcctcgtgtcgtgggtcctcgtggacagtcgactccacctatcctcctgacctactacggaaacccagcgagtgtagttggttaggtaatttaacttaccgttttctccgttacggtaaccaaacaaccaccgaaggaccaaaccgaccccctaaactcacgttacttaatttagacggtaccggactacgtacgacggaccccgtccccgttagggtacgggttccgtacgtacggtaccgtttcccggttcctttccgttccggtacccggtccctttaccccggtaccggtttccggtacgggacccgtaaccggacccggtaccccggttacccccttccgtaaccggtaacttaaccggtttcccggttaccgggttccgggtaccccttcccggggacggggtacccgggttaacgggggggaacggtaccgggtacgtttaggtttaaacttttacgttttaggttacgtttccggtttacgtaccgttagttacggtaccgggttcgggttaaggttacggttaccggggtacgggtaaccggggttaggggttcgggttaccggggacgggaacggttaaccggtacgggtcccgaacccgtttcgggtaaccgccgtaaccggtacccggtacggtccctacccccggttacccggtggttacccccg

SEQ ID NO: 168548 - DNA, 837 bp, Homo sapiens
  misc_feature: GYAE6OF01DEG81.49.82.H05.1.454.CMB.1.raw
  modified_base (234)..(234): a, c, t, g, unknown or other
  misc_feature (234)..(234): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacgagggtcctgggcccagtctcgcctgactcagcctgcctcgtgtcgtggtctccgtggacagtcgatccacctatcctcctgacctacgtacgaaaccgngcgaggtgtagttggttaggtaactttacttaaccttttcctaccgtacggtaacccaacctaaccgacccaaggaacctaaacccgaccccctaaacttactactttaccttaatttacgtacggaccggtaccgtaactaccggtaccggtccccggtacccgttacgggtaccggggttccttcgtacgtaccttccgtaccttcgtcgtccggtcctccgtacggtcgtggacgcgtaccgtaccgtccctaccgtacgaactacgttaccgtcggaccggtcctacccggaggggtacggtacggggggtacctacgggtaccgtttaagttaacgtttttacgttaacggtttcggtaacccgtttcgttaacggtacgtttaacgggttcccgggtacgggttacgtaacgggtttcggggtaaccggggtaacggggtttacgggggttccgggttaaacgggggaccggggaaaccggttaaccgggtaaacgggtccccggttaacccgggttacgtaaccgggtacccggtaaacccggtacccgggtacccggtcccgggtttaccccgtacccccgggtggttacccccg

SEQ ID NO: 168549 - DNA, 113 bp, Homo sapiens
  misc_feature: GYAE6OF01E2N0I.49.82.H05.1.454.CMB.1.raw
  modified_base (107)..(113): a, c, t, g, unknown or other
  misc_feature (107)..(113): n is a, c, g, or t
tcagagtcgagagacacgaccggtgctcgatttagtcgagctctctcgcgggcacgaccggtgctcgatttagtcgagctctctcgcgggctggcaaggcgcatagnnnnnnn

SEQ ID NO: 168550 - DNA, 702 bp, Homo sapiens
  misc_feature: GYAE6OF01C4FXP.49.82.H05.1.454.CMB.1.raw
  modified_base (229)..(229): a, c, t, g, unknown or other
  misc_feature (229)..(229): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctcgccctgactcagcctgcctcgtgtcgtgggtctccgtggacagtcgatcaccatctcctgcactacgaaaccngcagtgagttggttaggaatttacttaaccttttcgtccgtacggtaacctaaacaaaccctaccgaacggacaaaccgacccccaaactctatactattagtcggacggccgatcgacgccggtaccctcggtacgggtctcgtagtactcgtcttcgtaccgtcgtcctaccgtacgtcgtacggctacggccgtacccgtccctacgtacgactacttcgtcgtacgggtcctaccggacgggtcggtaccggggacggacgttcggtacgttaacgtttacgttactcgacgttacctacgttaactaaactaacgttaaacctaaactaaacgtaaacgtttcgggttacgggttaccggtaccgggtacgggaacccggtaaccgtaaccgtaccgtaacccgttcccggtacgaccgtaacccgccggtaccgacccgtccgtacccccggttgtacccttacccg

SEQ ID NO: 168551 - DNA, 155 bp, Homo sapiens
  misc_feature: GYAE6OF01A9LLC.49.82.H05.1.454.CMB.1.raw
  modified_base (137)..(137): a, c, t, g, unknown or other
  misc_feature (137)..(137): n is a, c, g, or t
  modified_base (142)..(155): a, c, t, g, unknown or other
  misc_feature (142)..(155): n is a, c, g, or t
tcagagtcgagagacacgaccggtgctcgatttagtcgagctctctcgcggcacgaccggtgctcgatttagtcgagctctctcgcggcacgaccggtgctcgatttagtcgagctctcgagcggctggcaaggcgnatagnnnnnnnnnnnnnn

SEQ ID NO: 168552 - DNA, 755 bp, Homo sapiens
  misc_feature: GYAE6OF01E112Z.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctctggacagtcgatcaccatcctctgcactgaaaccngcagtgtagttggttaggtaatttacttaacctttttcctccgtacggtaaccaacaaccacccaaggaccaaaccgacccccaaactcacttactactttagtacggacggtccgtactacaacggtcccggccccgttacggtacggggttcctcgtcgacgttcgtccttactcgtcggccttaccgacggtcgtggtacacggtccgacccggtccctacccgtacgtaactaaccgttccgtcggtcgggtccctacccgggacgggtcggggtacgggggaaccggtacgggtccgtaaggtttactttaagtttacgttcgttacgtttgttactagttaggtcgggtaccggttaggtaacggttggttaccgggacgggttaacggggttcgggttacggggacggggaaacggtaaccgggtaaacgggttaccgggtaacccggttccggtaaacggttacccggaccgtaaccccgggtacggtacccggttccccggttcccccggtggttaccccg

SEQ ID NO: 168553 - DNA, 191 bp, Homo sapiens
  misc_feature: GYAE6OF01CVH0U.49.82.H05.1.454.CMB.1.raw
  modified_base (172)..(191): a, c, t, g, unknown or other
  misc_feature (172)..(191): n is a, c, g, or t
tcagagtcgagagacacgaccggtgctcgatttagtcgagctctctcgcgggcacgaccggtgctcgatttagtcgagctctctcgcgggcacgaccggtgctcgatttagacgtcttcatcttcccgccagtctgatctctcgactctgagcgggctggcaaggcgcatgnnnnnnnnnnnnnnnnnnnn

SEQ ID NO: 168554 - DNA, 667 bp, Homo sapiens
  misc_feature: GYAE6OF01EWS8F.49.82.H05.1.454.CMB.1.raw
  modified_base (234)..(234): a, c, t, g, unknown or other
  misc_feature (234)..(234): n is a, c, g, or t
  modified_base (320)..(320): a, c, t, g, unknown or other
  misc_feature (320)..(320): n is a, c, g, or t
  modified_base (387)..(387): a, c, t, g, unknown or other
  misc_feature (387)..(387): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggactagtcgatccgaaccatcctctcgctactacgaaaccngcagtgtatggttaggtaacttactaaccttttctcgtagtaaccaacaacaccaggtacaaaccgaccccaaatcatctatttancgtacgccatcgacgcgtcctcgagggtctgtcgagtcctcgtctctggcctacgcgtcgtcggacncgccgtaccggtccctaccgtacgaactacgttccgtcggtggtccctacggacggccggtaggggaacgtgggtacttggtaaatttcgttagtcgtacgttgtaactagttacggtccggtacgggtagtaaggtacggacggggtaccggtagggtcgggttaccgggacgggtaacgggaaacgtaaccgggtaccgggtacccggttacgtaacggggtccgaacccggtaacccggtacggtaccccgtcccgggtacccccggttcggtaccc

SEQ ID NO: 168555 - DNA, 217 bp, Homo sapiens
  misc_feature: GYAE6OF01BD9DT.49.82.H05.1.454.CMB.1.raw
  modified_base (186)..(217): a, c, t, g, unknown or other
  misc_feature (186)..(217): n is a, c, g, or t
tcagagtcgagagacacgaccggtgctcgatttagtcgagctctctcgcggggctctctcgcgggcacgaccggtgctcgatttagtcacgcgaggaaagggaaagggggctggccctgacgtgtttctcgttccccgccctcctctctctcgactcgtgaggcgggctggacaacggcgcatagnnnnnnnnnnnnnnnnnnnnnnnnnnnnnnnn

SEQ ID NO: 168556 - DNA, 109 bp, Homo sapiens
  misc_feature: GYAE6OF01EX0CF.49.82.H05.1.454.CMB.1.raw
  modified_base (107)..(109): a, c, t, g, unknown or other
  misc_feature (107)..(109): n is a, c, g, or t
tcagagtcgagagacacgaccggtgctcgatttagtcgagctctctcgcgggcacgaccggtgctcgatttagtcgagctctctcgcgggctggcaaggcgcatagnnn

SEQ ID NO: 168557 - DNA, 747 bp, Homo sapiens
  misc_feature: GYAE6OF01EZBVF.49.82.H05.1.454.CMB.1.raw
  modified_base (425)..(425): a, c, t, g, unknown or other
  misc_feature (425)..(425): n is a, c, g, or t
tcagagtcgagagacacgaccggtgctcgatttagtcgagctctctcgcggggggggtcacaagaggcagcgctctcgggacgtctccaccatggcctggctctgctgctcctcactctcctcactcaggacacgagggtcctgggcccagtctcgccctgactcacgcctcgcctccgtgtcgtgggtctccgtcggactagtcgactaccacctatcctcctgacctacgtacgaaaaccgagtctaaggtgtagttagggttaggttaaactttaacttaacccgttttcctaccgttaccggtaaccctaaaccgaaaccaccgaacggaaccaaacccgaccccctaaactacctactactaatttacgtacggacgacccgtacgtaccgaccggccgtccccgtagggtacggttccncgtacgtcgtccgtccttacgtccttcggcccttacccgaccggtcgtacggtcccacggttcccgacccggtccctaccgacgtactacgttcctacggtcgtccgacggtcggtcgggacgggtaccggagtaccgttagtactttattacgtcgtggttacttaacgtgttaggtcgtacggtagtaaccggttgggttcgggtacggttcggggtcggtaccggggaacggtcggtaaccgggtacggtacggtaccggtaacgttccgggaaccgtccgtaacccggtcggcccgttaccgtccccgtacggtcccg

SEQ ID NO: 168558 - DNA, 250 bp, Homo sapiens
  misc_feature: GYAE6OF01AVVHM.49.82.H05.1.454.CMB.1.raw
  modified_base (224)..(250): a, c, t, g, unknown or other
  misc_feature (224)..(250): n is a, c, g, or t
tcagagtcgagagacacgaccggtgctcgatttagtcgagctctctcgcgggcacgaccggtgctcgatttagagagagtgtggttgggtttgggggaagaggaagactgaccggtccccccaggagttcaggtgcgtgggcacaggcggccctgggctgcctggtcaaggactaccttcctctctacgacctcgtggagcgggctggacgaaggcgcagtagnnnnnnnnnnnnnnnnnnnnnnnnnnn

SEQ ID NO: 168559 - DNA, 933 bp, Homo sapiens
  misc_feature: GYAE6OF01BRDWH.49.82.H05.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacgacgggtcctgggcccagtctcgcccgtgactcacgctcgcctcgtcgtcgtgggtcctccgtggacacgtcgactcacctatcctcctgccactacgaaaccngcagtgtagttggttaaggttaactttaacttaccttttccgtaccgttacggtaaccaacctaaccaccgaagaaccgaaaccgaaccccctaaacctactactacgttaactttagtacggacggtaccgtacgtaccgaccggcccggtcccggtcgggtaaccgggttccttacgtacgtaccgttaccgttccgtttccgtccgttccggtaccctacccggttaaccggttcggtacgggaccggaccggtaccccggtaaccccggtccctacccgttacgtaaacccgttaaccgtcccggttcggttacccggggtaccccgtaccggggacgggttacccggggtaaggggtaccggtacggtttaccgtttaaaggttttaaacccgtttttaaggtttccgtttacggttaaccttttacggttaaccgttaaggtttaccgggtacgggttaacccggggttaaggtccggttaacgggggtaccggggttaaccgggggttacggggtttccggggtaaacgggggaaccggggtaaacgggggtttaaaccggaaccggggttacccggggttaacccggttaccggggaacggtacccgggaaaccggttacccccggggtaccggttaaccccccggggttcccccggttaaccccgggttcccgttaaccccggg

SEQ ID NO: 168560 - DNA, 109 bp, Homo sapiens
  misc_feature: GYAE6OF02HBJIG.49.82.H05.1.454.CMB.1.raw
  modified_base (109)..(109): a, c, t, g, unknown or other
  misc_feature (109)..(109): n is a, c, g, or t
tcagagtcgagagacacgaccggtgctcgattagtcgagctctctcgcggcacgaccggtgctcgattagtcgagctctctcgactgagcggctggcaaggcgcatagn

SEQ ID NO: 168561 - DNA, 163 bp, Homo sapiens
  misc_feature: GYAE6OF02I5QBR.49.82.H05.1.454.CMB.1.raw
  modified_base (162)..(163): a, c, t, g, unknown or other
  misc_feature (162)..(163): n is a, c, g, or t
tcagagtcgagagacacgaccggtgctcgatttagtcgagctctctcgcgggcacgaccggtgctcgatttagtcacgcgagaaagggaagggctggccctgacgtgttctgttcccgccctcctctctctcgactctgagcgggctggcaaggcgcatagnn

SEQ ID NO: 168562 - DNA, 210 bp, Homo sapiens
  misc_feature: GYAE6OF02HD8S9.49.82.H05.1.454.CMB.1.raw
  modified_base (209)..(210): a, c, t, g, unknown or other
  misc_feature (209)..(210): n is a, c, g, or t
tcagagtcgagagacacgaccggtgctcgatttagtcgagctctctcgcgggcacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnn

SEQ ID NO: 168563 - DNA, 181 bp, Homo sapiens
  misc_feature: GYAE6OF02IBWEU.49.82.H05.1.454.CMB.1.raw
  modified_base (181)..(181): a, c, t, g, unknown or other
  misc_feature (181)..(181): n is a, c, g, or t
tcagagtcgagagacacgaccggtgctcgatttagtcgagctctctcgcgggcacgaccggtgctcgatttagctctacgctcagggcacgaccggtgctcgattagctacgctctaagggaagggttcctgttcccgcctcctctctctcgactctgagcgggctggcaaggcgcatagn

SEQ ID NO: 168564 - DNA, 247 bp, Homo sapiens
  misc_feature: GYAE6OF02HVB5R.49.82.H05.1.454.CMB.1.raw
  modified_base (244)..(247): a, c, t, g, unknown or other
  misc_feature (244)..(247): n is a, c, g, or t
tcagagtcgagagacacgaccggtgctcgatttagtcgagctctctcgcggcacgaccggtgctcgatttagtcgagctctctcgcgggcacgaccggtgctcgactttagagagagtgtgttgggttgggaagaggaagactgacggtccccaggagttcaggtgctggcacagcggccctgggctgcctggtcaaggactacttcctctctcgactctgagcgggctggcaaggcgcatagnnnn

SEQ ID NO: 168565 - DNA, 166 bp, Homo sapiens; identical to SEQ ID NO: 168291
  misc_feature: GYAE6OF02H111P.49.82.H05.1.454.CMB.1.raw
  modified_base (166)..(166): a, c, t, g, unknown or other
  misc_feature (166)..(166): n is a, c, g, or t

SEQ ID NO: 168566 - DNA, 171 bp, Homo sapiens
  misc_feature: GYAE6OF02G7APF.49.82.H05.1.454.CMB.1.raw
  modified_base (171)..(171): a, c, t, g, unknown or other
  misc_feature (171)..(171): n is a, c, g, or t
tcagagtcgagagacacgaccggtgctcgatttagtcgagctctctcgcgggcacgaccggtgctcgatttagtcgagctctctcgcgggtcgagctctctcgcgggcacgaccggtgctcgaaacaccctcctctctctcgactctgagcgggctggcaaggcgcatagn

SEQ ID NO: 168567 - DNA, 214 bp, Homo sapiens
  misc_feature: GYAE6OF02I7UTO.49.82.H05.1.454.CMB.1.raw
  modified_base (211)..(214): a, c, t, g, unknown or other
  misc_feature (211)..(214): n is a, c, g, or t
tcagagtcgagagacacgaccggtgctcgatttagtcgagctctctcgcgggcacgaccggtgctcgatttagagagagtgtggttgggtttggggaagaggaagactgacggtcccccaggagttcaggtgctgggcacagcggccctgggctgcctggtcaaggactacttcctctctcgactctgagcgggctggcaaggcgcatagnnnn

SEQ ID NO: 168568 - DNA, 169 bp, Homo sapiens
  misc_feature: GYAE6OF02HI7ZK.49.82.H05.1.454.CMB.1.raw
  modified_base (165)..(169): a, c, t, g, unknown or other
  misc_feature (165)..(169): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccaccctcctctctctcgactctgagcgggctggcaaggcgcatagnnnnn

SEQ ID NO: 168569 - DNA, 210 bp, Homo sapiens
  misc_feature: GYAE6OF02H3QC5.49.82.H05.1.454.CMB.1.raw
  modified_base (210)..(210): a, c, t, g, unknown or other
  misc_feature (210)..(210): n is a, c, g, or t
tcagagtcgagagacacgaccggtgctcgatttagtcgagctctctcgcgggcacgaccggtgctcgatttagagagagtgtggttgggtttggggaagaggaagactgacggtccccaggagttcaggtgctgggcacagcggccctgggctgcctggtcaaggactacttcctctctcgactctgagcgggctggcaaggcgcatagn

SEQ ID NO: 168570 - DNA, 164 bp, Homo sapiens; identical to SEQ ID NO: 168239
  misc_feature: GYAE6OF02JBYIN.49.82.H05.1.454.CMB.1.raw
  modified_base (164)..(164): a, c, t, g, unknown or other
  misc_feature (164)..(164): n is a, c, g, or t

SEQ ID NO: 168571 - DNA, 252 bp, Homo sapiens
  misc_feature: GYAE6OF02JADYH.49.82.H05.1.454.CMB.1.raw
  modified_base (248)..(252): a, c, t, g, unknown or other
  misc_feature (248)..(252): n is a, c, g, or t
tcagagtcgagagacacgaccggtgctcgatttagtcgagctctctcgcgggcacgaccggtgctcgatttagtcgagctctctcggggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnn

SEQ ID NO: 168572 - DNA, 292 bp, Homo sapiens
  misc_feature: GYAE6OF02HBBQV.49.82.H05.1.454.CMB.1.raw
  modified_base (286)..(292): a, c, t, g, unknown or other
  misc_feature (286)..(292): n is a, c, g, or t
tcagagtcgagagacacgaccggtgctcgatttagtcgagctctctcgcgggcacgaccggtgctcgattagtcgagctctctcgcgggcacgaccggtgctcgactttagtcgagctctctcgcgggcacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 168573 - DNA, 210 bp, Homo sapiens; identical to SEQ ID NO: 168562
  misc_feature: GYAE6OF02IMDXZ.49.82.H05.1.454.CMB.1.raw
  modified_base (209)..(210): a, c, t, g, unknown or other
  misc_feature (209)..(210): n is a, c, g, or t

SEQ ID NO: 168574 - DNA, 113 bp, Homo sapiens
  misc_feature: GYAE6OF02H5WVK.49.82.H05.1.454.CMB.1.raw
  modified_base (113)..(113): a, c, t, g, unknown or other
  misc_feature (113)..(113): n is a, c, g, or t
tcagagtcgagagacacgaccggtgctcgatttagtcgagctctctcgcgggcacgaccggtgctcgatttagtcgagctctctcgactgagcgggctggcaaggcgcatagn

SEQ ID NO: 168575 - DNA, 162 bp, Homo sapiens
  misc_feature: GYAE6OF02JHOHK.49.82.H05.1.454.CMB.1.raw
  modified_base (160)..(162): a, c, t, g, unknown or other
  misc_feature (160)..(162): n is a, c, g, or t
tcagagtcgagagacacgaccggtgctcgatttagtcgagctctctcgcggcacgaccggtgctcgatttagtcacgcgagaaaggaaaggggcgtggccctgacgtgttctgttccacctcctctctctcgactctgagcggctggcaaggcgcatagnnn

SEQ ID NO: 168576 - DNA, 236 bp, Homo sapiens
  misc_feature: GYAE6OF02GC25F.49.82.H05.1.454.CMB.1.raw
  modified_base (211)..(236): a, c, t, g, unknown or other
  misc_feature (211)..(236): n is a, c, g, or t
tcagagtcgagagacacgaccggtgctcgatttagtcgagctctctcgcgggcacgaccggtgctcgatttagagagagtgtggttgggtttgggggaagaggaagactgacggtcccccaggagttcaggtgctgggcacagcggccctggctgcctggtcaaggactacttcctctctcgactctgagcgggctggcaaggcgcatagnnnnnnnnnnnnnnnnnnnnnnnnnn

SEQ ID NO: 168577 - DNA, 165 bp, Homo sapiens; identical to SEQ ID NO: 168266
  misc_feature: GYAE6OF02IB8S1.49.82.H05.1.454.CMB.1.raw
  modified_base (165)..(165): a, c, t, g, unknown or other
  misc_feature (165)..(165): n is a, c, g, or t

SEQ ID NO: 168578 - DNA, 107 bp, Homo sapiens
  misc_feature: GYAE6OF02JB43W.49.82.H05.1.454.CMB.1.raw
  modified_base (107)..(107): a, c, t, g, unknown or other
  misc_feature (107)..(107): n is a, c, g, or t
tcagagtcgagagacacgaccggtgctcgatttagtcgagctctctcgcgggcacgaccggtgctcgatttagtcgagctctcgagcgggctggcaaggcgcatagn

SEQ ID NO: 168579 - DNA, 170 bp, Homo sapiens
  misc_feature: GYAE6OF02FU7Q6.49.82.H05.1.454.CMB.1.raw
  modified_base (170)..(170): a, c, t, g, unknown or other
  misc_feature (170)..(170): n is a, c, g, or t
tcagagtcgagagacacgaccggtgctcgatttagtcgagctctctcgcgggcacgaccggtgctcgatttagtcgagctctctcgcgggtcgagctctctcgcgggcacgaccggtgctcgaaacaccgtccctctctcgactctgagcgggctggcaaggcgcatagn

SEQ ID NO: 168580 - DNA, 198 bp, Homo sapiens
  misc_feature: GYAE6OF02IS65R.49.82.H05.1.454.CMB.1.raw
  modified_base (196)..(198): a, c, t, g, unknown or other
  misc_feature (196)..(198): n is a, c, g, or t
tcagagtcgagagacacgaccggtgctcgatttagtcgagctctctcgcgggcacgaccggtgctcgatttggtcgagctctctcgcgggcacgaccggtgctcgatttagtagtgtagattccgcgggatctacactactaaatcgagcaccggtcgtgtctctcgactctgagcgggctggcaaggcgcatagnnn

SEQ ID NO: 168581 - DNA, 498 bp, Homo sapiens
  misc_feature: GYAE6OF02H04XV.49.82.H05.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagagtcgagagacacgaccggtgctcgatttagtcgagctctctcgcgggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggcctcaggggtctctgatcgcttctctggctccacgtctggcagcacggctccctgacaatctctggctcaggctggggacaggctgattattactgcagctcatatacaaacataaacncttggngttcggcggcgggacaacgtgaccgtctacgtcagcccaaggcctcgcccctcggtcacg

SEQ ID NO: 168582 - DNA, 212 bp, Homo sapiens; identical to SEQ ID NO: 168240
  misc_feature: GYAE6OF02FLGYH.49.82.H05.1.454.CMB.1.raw
  modified_base (212)..(212): a, c, t, g, unknown or other
  misc_feature (212)..(212): n is a, c, g, or t

SEQ ID NO: 168583 - DNA, 212 bp, Homo sapiens; identical to SEQ ID NO: 168241
  misc_feature: GYAE6OF02G1XTS.49.82.H05.1.454.CMB.1.raw
  modified_base (211)..(212): a, c, t, g, unknown or other
  misc_feature (211)..(212): n is a, c, g, or t

SEQ ID NO: 168584 - DNA, 521 bp, Homo sapiens
  misc_feature: GYAE6OF02HJAZX.49.82.H05.1.454.CMB.1.raw
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacatctctgggctccaggctggggacgaggctgattattattgctgttcattatgccggtgatagtggccgtaagggtgttcgggcggagggacgaaagggtcgaccggtccgtaggtcgacggcccaaggcctacggcccccgtggtcc

SEQ ID NO: 168585 - DNA, 177 bp, Homo sapiens
  misc_feature: GYAE6OF02GR38P.49.82.H05.1.454.CMB.1.raw
  modified_base (176)..(177): a, c, t, g, unknown or other
  misc_feature (176)..(177): n is a, c, g, or t
tcagagtcgagagacacgaccggtgctcgatttagtcgagctctctcgcgggctctctcgcgggcacgaccggtgctcgatttagtcacgcgagaaagggaaggggctggccctgacgtgtttctgttcccgccctcctctctctcgactctgagcgggctggcaaggcgcatagnn

SEQ ID NO: 168586 - DNA, 249 bp, Homo sapiens
  misc_feature: GYAE6OF02GOHFA.49.82.H05.1.454.CMB.1.raw
  modified_base (247)..(249): a, c, t, g, unknown or other
  misc_feature (247)..(249): n is a, c, g, or t
tcagagtcgagagacacgaccggtgctcgatttagtcgagctctctcgcgggcacgaccggtgctcgatttagtcgagctctctcgcgggcacgaccggtgctcgatttagagtgagctcgttgggttggggaagaggaagactgacggtcccccaggagttcaggtgctgggcacagcggccctgggctgcctggtcaaggactacttcctctctcgactctgagcgggctggcaaggcgcatagnnn

SEQ ID NO: 168587 - DNA, 163 bp, Homo sapiens
  misc_feature: GYAE6OF02JM494.49.82.H05.1.454.CMB.1.raw
  modified_base (158)..(163): a, c, t, g, unknown or other
  misc_feature (158)..(163): n is a, c, g, or t
tcagagtcgagagacacgaccggtgctcgatttagtcgagctctctcgcggcacgaccggtgctcgatttagtcacgcgagaaggaaaggggctggccctgacgtgttctgttccacctcctctctctcgactctgagcggctggcaaggcgcatagnnnnnn

SEQ ID NO: 168588 - DNA, 194 bp, Homo sapiens
  misc_feature: GYAE6OF02GJHEC.49.82.H05.1.454.CMB.1.raw
  modified_base (194)..(194): a, c, t, g, unknown or other
  misc_feature (194)..(194): n is a, c, g, or t
tcagagtcgagagacacgaccggtgctcgattagtcgagctctctcgcgggcacgaccggtgctcgatttagtcacgcgagaaagggaaaggggtgctcgatttagtcacgcgagaaaggaaaggtggccctgacgtgtttctgttcccgccctcctctctctcgactctgagcgggctggcaaggcgcatagn

SEQ ID NO: 168589 - DNA, 249 bp, Homo sapiens
  misc_feature: GYAE6OF02FNQQT.49.82.H05.1.454.CMB.1.raw
  modified_base (248)..(249): a, c, t, g, unknown or other
  misc_feature (248)..(249): n is a, c, g, or t
tcagagtcgagagacacgaccggtgctcgatttagtcgagctctctcgcgggcacgaccggtgctcgatttagtcgagctctctcgcgggcacgaccggtgctcgactttagagagagtgtgttgggtttggggaagaggaagactgacggtcccccaggagttcaggtgctgggcacagcggccctgggctgcctggtcaaggctacttcctctctcgactctgagcgggctggcaaggcgcatagnn

SEQ ID NO: 168590 - DNA, 167 bp, Homo sapiens
  misc_feature: GYAE6OF02GMH99.49.82.H05.1.454.CMB.1.raw
  modified_base (166)..(167): a, c, t, g, unknown or other
  misc_feature (166)..(167): n is a, c, g, or t
tcagagtcgagagacacgaccggtgctcgatttagtcgagctctctcgcgggcacgaccggtgctcgatttagtcacgcgagaaagggaaagggggctggccctgacgtgtttctgttcccaccctcctctctctcgactctgagcgggctggcaaggcgcatagnn

SEQ ID NO: 168591 - DNA, 165 bp, Homo sapiens; identical to SEQ ID NO: 168231
  misc_feature: GYAE6OF02HFHQ0.49.82.H05.1.454.CMB.1.raw
  modified_base (165)..(165): a, c, t, g, unknown or other
  misc_feature (165)..(165): n is a, c, g, or t

SEQ ID NO: 168592 - DNA, 165 bp, Homo sapiens
  misc_feature: GYAE6OF02IFGBW.49.82.H05.1.454.CMB.1.raw
  modified_base (165)..(165): a, c, t, g, unknown or other
  misc_feature (165)..(165): n is a, c, g, or t
tcagagtcgagagacacgaccggtgctcgatttagtcgagctctctcgcgggcacgaccggtgctcgatttattcacgcgagaaagggaaaggggctggccctgacgtgtttctgttcccgccctcctctctctcgactctgagcgggctggcaaggcgcatagn

SEQ ID NO: 168593 - DNA, 166 bp, Homo sapiens
  misc_feature: GYAE6OF02I6QY9.49.82.H05.1.454.CMB.1.raw
  modified_base (165)..(166): a, c, t, g, unknown or other
  misc_feature (165)..(166): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccaccctcctctctctcgactctgagcgggctggcaaggcgcatagnn

SEQ ID NO: 168594 - DNA, 214 bp, Homo sapiens
  misc_feature: GYAE6OF02IZKXZ.49.82.H05.1.454.CMB.1.raw
  modified_base (210)..(214): a, c, t, g, unknown or other
  misc_feature (210)..(214): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnnnn

SEQ ID NO: 168595 - DNA, 212 bp, Homo sapiens; identical to SEQ ID NO: 168241
  misc_feature: GYAE6OF02FZFTU.49.82.H05.1.454.CMB.1.raw
  modified_base (211)..(212): a, c, t, g, unknown or other
  misc_feature (211)..(212): n is a, c, g, or t

SEQ ID NO: 168596 - DNA, 211 bp, Homo sapiens
  misc_feature: GYAE6OF02GP6SF.49.82.H05.1.454.CMB.1.raw
  modified_base (210)..(211): a, c, t, g, unknown or other
  misc_feature (210)..(211): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcgcatagnn

SEQ ID NO: 168597 - DNA, 165 bp, Homo sapiens
  misc_feature: GYAE6OF02II27W.49.82.H05.1.454.CMB.1.raw
  modified_base (165)..(165): a, c, t, g, unknown or other
  misc_feature (165)..(165): n is a, c, g, or t
tcagagtcgagagacacgaccggtgctcgattagtcgagctctctcgcggtcacgaccggtgctcgatttagtcacgcgagaaagggaaagggggctggccctgacgtgtttctgttcccaccctcctctctctcgactctgagcgggctggcaaggcgcatagn

SEQ ID NO: 168598 - DNA, 214 bp, Homo sapiens; identical to SEQ ID NO: 168278
  misc_feature: GYAE6OF02H1QOK.49.82.H05.1.454.CMB.1.raw
  modified_base (211)..(214): a, c, t, g, unknown or other
  misc_feature (211)..(214): n is a, c, g, or t

SEQ ID NO: 168599 - DNA, 213 bp, Homo sapiens
  misc_feature: GYAE6OF02HYMUX.49.82.H05.1.454.CMB.1.raw
  modified_base (212)..(213): a, c, t, g, unknown or other
  misc_feature (212)..(213): n is a, c, g, or t
tcagagtcgagagacacgaccggtgctcgatttagtcgagctctctcgcgggcacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 168600 - DNA, 214 bp, Homo sapiens
  misc_feature: GYAE6OF02HQYAF.49.82.H05.1.454.CMB.1.raw
  modified_base (212)..(214): a, c, t, g, unknown or other
  misc_feature (212)..(214): n is a, c, g, or t
tcagagtcgagagacacgaccggtgctcgatttagtcgagctctctcgcgggcacgaccggtgctcgatttagagagagtgtggttgggtttgggggaagaggaagactgacggtcccccaggagttcaggtgctgggcacagcggccctgggctgcctggtcaaggactacttcctcgtagcactctgagcgggctggcaaggcgcatagnnn

SEQ ID NO: 168601 - DNA, 313 bp, Homo sapiens
  misc_feature: GYAE6OF02JF5PN.49.82.H05.1.454.CMB.1.raw
  modified_base (301)..(313): a, c, t, g, unknown or other
  misc_feature (301)..(313): n is a, c, g, or t
tcagagtcgagagacacgaccggtgctcgatttagtcgagctctctcgcgggcacgaccggtgctcgactttagtcgagctctctcggcgggcacgaccggtgctcgactttagtcgagcgtctctcggtcgggcacgaccggtcgcgtcgacttagagagaggtgtcgttgggttgggggaagaggaagactggacggtcccccgaggaggttcaggtgctgggcacagcggccctgggctgcctggtcaagggactacttcctctctcgactctgagcgggctgggcaaggcgcatagnnnnnnnnnnnnn

SEQ ID NO: 168602 - DNA, 211 bp, Homo sapiens; identical to SEQ ID NO: 168264
  misc_feature: GYAE6OF02I3ERM.49.82.H05.1.454.CMB.1.raw
  modified_base (211)..(211): a, c, t, g, unknown or other
  misc_feature (211)..(211): n is a, c, g, or t

SEQ ID NO: 168603 - DNA, 197 bp, Homo sapiens
  misc_feature: GYAE6OF02F5J34.49.82.H05.1.454.CMB.1.raw
  modified_base (195)..(197): a, c, t, g, unknown or other
  misc_feature (195)..(197): n is a, c, g, or t
tcagagtcgagagacacgaccggtgctcgattagtcgagctctctcgcgggcacgaccggtgctcgatttagtcacgcgagaaagggaaaggggtgctcgatttagtcacgcgagaaagggaaaggtggccctgacgtgtttctgttcccaccctcctctctctcgactctgagcgggctggcaaggcgcatagnnn

SEQ ID NO: 168604 - DNA, 831 bp, Homo sapiens
  misc_feature: GYAE6OF02I2GIU.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactacgaaaccngacagtgagtggttaggtaattacttaaccttttctcgtgtaaccaacaaccaccgaggacaaaccgacccccaaactacactacctaatttagtacggacggaccgtaataccgacggccggtcccctacggtacggggttcctcgtagactccgtccttctcgtcggccttacccgacggttccgtcggaccgtacgaccgaccgggtccctcccgtacgtaactaacttccttcggtcggggtaccctcccggacgggtccgggttacggggggaaccggtacgggtaccgttaggttaagtttttaacgttttaacgtttcggtccgttttaccggtttaacttaacgtttacgttaccggggttacccggggttagtttaaacggtttacgggttaccgggggtaaccccgggttaaaggggggtttccgggttttacccgggggaccggggggtaaaccgggggtaaccggttaaacgggggttaccgggtaacccccgggtttaacccgggtttaacggggtacccggtaacccggtacccccggaaagggttccccggttaccccgggtccccccccggttaccgggtttaacccccg

SEQ ID NO: 168605 - DNA, 251 bp, Homo sapiens
  misc_feature: GYAE6OF02I5ZN4.49.82.H05.1.454.CMB.1.raw
  modified_base (246)..(251): a, c, t, g, unknown or other
  misc_feature (246)..(251): n is a, c, g, or t
tcagagtcgagagacacgaccggtgctcgatttagtcgagctctctcgcgggcacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 168606 - DNA, 165 bp, Homo sapiens; identical to SEQ ID NO: 168266
  misc_feature: GYAE6OF02F91N5.49.82.H05.1.454.CMB.1.raw
  modified_base (165)..(165): a, c, t, g, unknown or other
  misc_feature (165)..(165): n is a, c, g, or t

SEQ ID NO: 168607 - DNA, 548 bp, Homo sapiens
  misc_feature: GYAE6OF02JU5TW.49.82.H05.1.454.CMB.1.raw
  modified_base (403)..(403): a, c, t, g, unknown or other
  misc_feature (403)..(403): n is a, c, g, or t
  modified_base (474)..(474): a, c, t, g, unknown or other
  misc_feature (474)..(474): n is a, c, g, or t
tcagagtcgagagacacgaccggtgctcgatttagtcgagctctctcgcgggggtcgacgaagaggcagcgctctcggacgtctccaccatgcctggctctgctgctcctcactctcctcactcagacacaggtcctgggcccagtctgccctgactcagcctgcctccgtgtctgggtctcctggacagtcgatcaccatctctcgcactgaaaccagcagtgatgttggaattataaccttttctctgtaccaacacacccagcaaacgccccaaactcatacatttactgaggccaatcagcgccctcaggggtctacgtgacgtctcttctctggtcctcccacgttctggcagccacggccctccctgacactctcgtcggctccgagcgtacggganaggctgtattattagtgtccttgttcattagtgtccggtgtatgtcgggtcggtaacgggttggttccggngggtaaggacggtaaagggtcgtaccggtccgtaggtccaggtccccgaaggtccgtcgcccccgtggttaccg

SEQ ID NO: 168608 - DNA, 502 bp, Homo sapiens
  misc_feature: GYAE6OF02J0XXT.49.82.H05.1.454.CMB.1.raw
  modified_base (319)..(319): a, c, t, g, unknown or other
  misc_feature (319)..(319): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctnagggtctctgatcgcttctctggctccacgtctggcagcacggcctccctgacatctctggctccaggctggggacaggctgattatatgctgttcatntgcgtnatgtggcgaaggtgtcggcggaggaccgaagggtcaccggtcctaggtccacggcccaaggcctcgcccccgtggtcc

SEQ ID NO: 168609 - DNA, 167 bp, Homo sapiens
  misc_feature: GYAE6OF02HHGC4.49.82.H05.1.454.CMB.1.raw
  modified_base (165)..(167): a, c, t, g, unknown or other
  misc_feature (165)..(167): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccaccctcctctctctcgactctgagcgggctggcaaggcgcatagnnn

SEQ ID NO: 168610 - DNA, 211 bp, Homo sapiens
  misc_feature: GYAE6OF02G1L68.49.82.H05.1.454.CMB.1.raw
tcagagtcgagagacacgaccggtgctcgatttagtcgagctctctcgcgggcacgaccggtgctcgatttagagagagtgtggttgggtttgggggaagaggaagactgacggtcccccaggagttcaggtgctgggcacagcggccctgggctgcctggtcaaggactacttcctcgtagcactctgagcgggctggcaaggcgcatag

SEQ ID NO: 168611 - DNA, 543 bp, Homo sapiens
  misc_feature: GYAE6OF02GDZMU.49.82.H05.1.454.CMB.1.raw
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaatcatcatttatgaggccgatcagcggccctcaggggtctctgatcgcttctctggctccacgtctggcagcacggcctccctgacaatctcgtgggcctccgaggcgtggggacgaggctgatttattattgcttgttcattagtcggccggtgagttaggtcggaccggtaaggggttcgttcgggcgggagggaccgaagggtcgacccggtccgtaggtccacggcccgaaggcctccggcccccgtggtccc

SEQ ID NO: 168612 - DNA, 166 bp, Homo sapiens
  misc_feature: GYAE6OF02HMAVF.49.82.H05.1.454.CMB.1.raw
  modified_base (166)..(166): a, c, t, g, unknown or other
  misc_feature (166)..(166): n is a, c, g, or t
tcagagtcgagagacacgaccggtgctcgatttagtcgagctctctcgcgggcacgaccggtgctcgatttagtcacgcgagaaagggaaagggggctggccctgacgtgtttctgttcccgccctcctctctctcgactctgagcgggctggcaaggcgcatagn

SEQ ID NO: 168613 - DNA, 223 bp, Homo sapiens
  misc_feature: GYAE6OF02IT7HD.49.82.H05.1.454.CMB.1.raw
  modified_base (112)..(112): a, c, t, g, unknown or other
  misc_feature (112)..(112): n is a, c, g, or t
  modified_base (162)..(223): a, c, t, g, unknown or other
  misc_feature (162)..(223): n is a, c, g, or t
tcagagtcgagagacacgaccggtgctcgatttagtcgagctctctcgcgggcacgaccggtgctcgatttagtcacgcgagaaagggaaggggctggccctgacgtgttcngttcccacctcctctctctcgactctgagcgggctggcaaggcgcatagnnnnnnnnnnnnnnnnnnnnnnnnnnnnnnnnnnnnnnnnnnnnnnnnnnnnnnnnnnnnnn

SEQ ID NO: 168614 - DNA, 509 bp, Homo sapiens
  misc_feature: GYAE6OF02I0CRU.49.82.H05.1.454.CMB.1.raw
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcgccctcaggggtctctgatcgcttctctggctccaagtctgcaacacggcctcctgaccgtctctgggctccgggctgaagntggagctgatttatttcngcagctcatatgcaggcagacaactaattttgngtatagttcggcggtaggaccaaggctagacccgtcgtaggtaccacgacccgaaggtcccg

SEQ ID NO: 168615 - DNA, 165 bp, Homo sapiens
  misc_feature: GYAE6OF02GTVQT.49.82.H05.1.454.CMB.1.raw
tcagagtcgagagacacgaccggtgctcgatttagtcgagctctctcgcgggcacgaccggtgctcgatttagtcacgcgagaaagggaaagggggctggccctgacgtgtttctgttcccaccctcctctctctcgactctgagcgggctggcaaggcgcatag

SEQ ID NO: 168616 - DNA, 512 bp, Homo sapiens
  misc_feature: GYAE6OF02GPTFU.49.82.H05.1.454.CMB.1.raw
  modified_base (397)..(397): a, c, t, g, unknown or other
  misc_feature (397)..(397): n is a, c, g, or t
tcagagtcgagagacacgaccggtgctcgatttagtcgagctctctcgcgggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacacccaggcaaagcccccaaactcatcattatgagccgatcagcggccctcaggggtctctgatcgcttctctggctccacgtctggcagcacggcctccctgaccaatctctgggctccaggctggggacgnggctgatttattattgctgttcatatgccgtgattagtggccgtaagggtcgttcggcggagggacgaaggtcgaccgtcgtaggtcagcccgaaggcctcggccccctggtccc

SEQ ID NO: 168617 - DNA, 210 bp, Homo sapiens; identical to SEQ ID NO: 168226
  misc_feature: GYAE6OF02IPXYL.49.82.H05.1.454.CMB.1.raw
  modified_base (210)..(210): a, c, t, g, unknown or other
  misc_feature (210)..(210): n is a, c, g, or t

SEQ ID NO: 168618 - DNA, 223 bp, Homo sapiens
  misc_feature: GYAE6OF02HSAIE.49.82.H05.1.454.CMB.1.raw
  modified_base (210)..(223): a, c, t, g, unknown or other
  misc_feature (210)..(223): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcgcatagnnnnnnnnnnnnnn

SEQ ID NO: 168619 - DNA, 213 bp, Homo sapiens; identical to SEQ ID NO: 168599
  misc_feature: GYAE6OF02ICXQP.49.82.H05.1.454.CMB.1.raw
  modified_base (212)..(213): a, c, t, g, unknown or other
  misc_feature (212)..(213): n is a, c, g, or t

SEQ ID NO: 168620 - DNA, 249 bp, Homo sapiens
  misc_feature: GYAE6OF02HGRJ3.49.82.H05.1.454.CMB.1.raw
  modified_base (248)..(249): a, c, t, g, unknown or other
  misc_feature (248)..(249): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnn

SEQ ID NO: 168621 - DNA, 515 bp, Homo sapiens
  misc_feature: GYAE6OF02GTAUE.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacgttgggtgttcggcggcgggaccaacgtgaccgtcctacgtcacgcccgaaggctcgcccctcggtcactctccg

SEQ ID NO: 168622 - DNA, 548 bp, Homo sapiens
  misc_feature: GYAE6OF02JEG2P.49.82.H05.1.454.CMB.1.raw
  modified_base (443)..(443): a, c, t, g, unknown or other
  misc_feature (443)..(443): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagccggccctcgaggggtctctgatcgcttctctggctccacgtctggcagcaccggcctccctcgacaactctcgtgggcctccgaggcgtggggacgaggctgtattattattgctgttcatatcgcggtntagtagtggaccggaagggttcgttcgggacggtacgggaccgaagggtcgaccggtccgtaggtccgacggtcccgaaggccgtcggccccccgtcggtacccg

SEQ ID NO: 168623 - DNA, 244 bp, Homo sapiens
  misc_feature: GYAE6OF02I6A5Y.49.82.H05.1.454.CMB.1.raw
  modified_base (243)..(244): a, c, t, g, unknown or other
  misc_feature (243)..(244): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttccgactctgagcgggctggcaaggcgcatagnn

SEQ ID NO: 168624 - DNA, 198 bp, Homo sapiens
  misc_feature: GYAE6OF02H7XEY.49.82.H05.1.454.CMB.1.raw
  modified_base (197)..(198): a, c, t, g, unknown or other
  misc_feature (197)..(198): n is a, c, g, or t
tcagagtcgagagacacgaccggtgctcgatttagtcgagctctctcgcgggcacgaccggtgctcgatttagctctacgctcagggcacgaccggtgctcgatttagtcacgcgagaaagggaagggctggccctgacgtgtttctgttcccacctcctctctctcgactctgagcgggctggcaaggcgcatagnn

SEQ ID NO: 168625 - DNA, 217 bp, Homo sapiens
  misc_feature: GYAE6OF02JAZ04.49.82.H05.1.454.CMB.1.raw
  modified_base (210)..(217): a, c, t, g, unknown or other
  misc_feature (210)..(217): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnnnnnnn

SEQ ID NO: 168626 - DNA, 213 bp, Homo sapiens
  misc_feature: GYAE6OF02HE1AV.49.82.H05.1.454.CMB.1.raw
  modified_base (211)..(213): a, c, t, g, unknown or other
  misc_feature (211)..(213): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 168627 - DNA, 505 bp, Homo sapiens
  misc_feature: GYAE6OF02F7ERX.49.82.H05.1.454.CMB.1.raw
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcgccctcaggggtctctgatcgcttctctggctccacgtctggcagcacggcctccctgacaatctctgggctccaggctgggacgaggctgattattattgctgttcatatgccggtgatagtggcgaagggtgttcggcggaggaccgaaggtcgaccgtcgtaggtcacgcccgaaggctcgcccctggtcc

SEQ ID NO: 168628 - DNA, 212 bp, Homo sapiens
  misc_feature: GYAE6OF02G8RSP.49.82.H05.1.454.CMB.1.raw
  modified_base (212)..(212): a, c, t, g, unknown or other
  misc_feature (212)..(212): n is a, c, g, or t
tcagagtcgagagacacgaccggtgctcgatttagtcgagctctctcgcgggcacgaccggtgctcgatttagagagagtgtgttgggtttgggggaagaggaagactgaccggtcccccaggagttcaggtgctgggcacagcggccctgggctgcctggtcaaggactacttcctcgtagcactctgagcgggctggcaaggcgcatagn

SEQ ID NO: 168629 - DNA, 251 bp, Homo sapiens; identical to SEQ ID NO: 168238
  misc_feature: GYAE6OF02GR590.49.82.H05.1.454.CMB.1.raw
  modified_base (249)..(251): a, c, t, g, unknown or other
  misc_feature (249)..(251): n is a, c, g, or t

SEQ ID NO: 168630 - DNA, 165 bp, Homo sapiens
  misc_feature: GYAE6OF02FOIL1.49.82.H05.1.454.CMB.1.raw
  modified_base (164)..(165): a, c, t, g, unknown or other
  misc_feature (164)..(165): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccaccctcctctctctcgactctgagcggctggcaaggcgcatagnn

SEQ ID NO: 168631 - DNA, 544 bp, Homo sapiens
  misc_feature: GYAE6OF02II4JW.49.82.H05.1.454.CMB.1.raw
  modified_base (298)..(298): a, c, t, g, unknown or other
  misc_feature (298)..(298): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccagcaaagcccccaaactcatcatttangagaccgatcagccgcctcagggtctctgatcgcttctctggctccacgtctggcagcacggcctccctgacaatcctcgtgggcctccgaggctggggacgaggctagattattattgctgttcatatggccgtgagttagtcgggaccgtaagggtgttcgggacggtagggaccgtaaagggtcggaacccgtccgtaggtaccacgaccccgaaggtcctaccggccccccgttggtacccg

SEQ ID NO: 168632 - DNA, 504 bp, Homo sapiens
  misc_feature: GYAE6OF02IGDOG.49.82.H05.1.454.CMB.1.raw
  modified_base (300)..(300): a, c, t, g, unknown or other
  misc_feature (300)..(300): n is a, c, g, or t
  modified_base (400)..(400): a, c, t, g, unknown or other
  misc_feature (400)..(400): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttangaggccgatcagcggccctcgaggggtctctgatcgcttctctggctccacgtctgcagcacggcctcctgacaatctctggctccaggcgtggggacgnggctgattattattgctgttcatatgccgtgatagtggccgaaggtgttcggcggaggacgaaggtgaccgtcgtaggtcacgccgaggctcgccccctggtcc

SEQ ID NO: 168633 - DNA, 108 bp, Homo sapiens
  misc_feature: GYAE6OF02GZK3Z.49.82.H05.1.454.CMB.1.raw
  modified_base (107)..(108): a, c, t, g, unknown or other
  misc_feature (107)..(108): n is a, c, g, or t
tcagagtcgagagacacgaccggtgctcgatttagtcgagctctctcgcgggcacgaccggtgctcgatttagtcgagctctctagcgggctggcaaggcgcatagnn

SEQ ID NO: 168634 - DNA, 166 bp, Homo sapiens; identical to SEQ ID NO: 168291
  misc_feature: GYAE6OF02IYRY0.49.82.H05.1.454.CMB.1.raw
  modified_base (166)..(166): a, c, t, g, unknown or other
  misc_feature (166)..(166): n is a, c, g, or t

SEQ ID NO: 168635 - DNA, 213 bp, Homo sapiens; identical to SEQ ID NO: 168218
  misc_feature: GYAE6OF02IU2EK.49.82.H05.1.454.CMB.1.raw
  modified_base (211)..(213): a, c, t, g, unknown or other
  misc_feature (211)..(213): n is a, c, g, or t

SEQ ID NO: 168636 - DNA, 526 bp, Homo sapiens
  misc_feature: GYAE6OF02GPW03.49.82.H05.1.454.CMB.1.raw
  modified_base (319)..(319): a, c, t, g, unknown or other
  misc_feature (319)..(319): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcggccctnagggtctctgatcgcttctctggctccacgtctggcagcacgcctcctgacaatctctgggcctccgaggcgtggggacgaggcttgattattattgctgttcatatgccggtgataggtggccggtaagggtcgttacgggcggagggacgaaagggtgaccggttcgtaggtcacggcccgaaggctcggtaccccctggtaccc

SEQ ID NO: 168637 - DNA, 212 bp, Homo sapiens
  misc_feature: GYAE6OF02GK5DT.49.82.H05.1.454.CMB.1.raw
  modified_base (211)..(212): a, c, t, g, unknown or other
  misc_feature (211)..(212): n is a, c, g, or t
tcagagtcgagagacacgaccggtgctcgatttagtcgagctctctcgcgggcacgaccggtgctcgatttagagagagtgtggttgggtttgggggaagaggaagactgacggtccccaggagttcaggtgctgggcacagcggccctgggctgcctggtcaaggactacttcctctctcgactctgagcgggctggcaaggcgcatagnn

SEQ ID NO: 168638 - DNA, 564 bp, Homo sapiens
  misc_feature: GYAE6OF02GQJQ0.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcgccctcgagggtctctgatcgcttctctggctccacgtctggcagcacggcctccctgaccaatctcgtgggcctccgaggcgtggggacgaggctgatttattattgcttgttcatagtcggccgttgagttaggtcggaccggtaaggggttcggttcgggcgggtaacgggacgtaaaggggtcgtaacccggttccgtaagggtccaacggccccgaagggccctaccggtccccccgtaggtaccc

SEQ ID NO: 168639 - DNA, 201 bp, Homo sapiens
  misc_feature: GYAE6OF02GP3BQ.49.82.H05.1.454.CMB.1.raw
  modified_base (198)..(201): a, c, t, g, unknown or other
  misc_feature (198)..(201): n is a, c, g, or t
tcagagtcgagagacacgaccggtgctcgatttagtcgagctctctcgcgggcacgaccggtgctcgatttagctctacgctcagggcacgaccggtgctcgatttagtcacgcgagaaagggaagggctggccctgacgtgtttctgttcccgccctcctctctctcgactctgagcgggctggcaaggcgcatagnnnn

SEQ ID NO: 168640 - DNA, 213 bp, Homo sapiens; identical to SEQ ID NO: 168626
  misc_feature: GYAE6OF02FPB4B.49.82.H05.1.454.CMB.1.raw
  modified_base (211)..(213): a, c, t, g, unknown or other
  misc_feature (211)..(213): n is a, c, g, or t

SEQ ID NO: 168641 - DNA, 514 bp, Homo sapiens
  misc_feature: GYAE6OF02GHEF1.49.82.H05.1.454.CMB.1.raw
  modified_base (300)..(300): a, c, t, g, unknown or other
  misc_feature (300)..(300): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttangagccgatcagcggccctcaggggtctctgatcgcttctctggctccacgtctggcagcacggccctccctgacaatctctcgggctccgaggctggggacgaggcttgattattagttgcttgttcatatgcgtgagttagtggccgaagggtgtcggnggaggacgaaaggtgaccgtcgtaggtcacgccgaaggctcggcccctggtacc

SEQ ID NO: 168642 - DNA, 519 bp, Homo sapiens
  misc_feature: GYAE6OF02HVISA.49.82.H05.1.454.CMB.1.raw
  modified_base (436)..(436): a, c, t, g, unknown or other
  misc_feature (436)..(436): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaatcatcatttatgaggccgatcagcggccctcgaggggtctctgatcgcttctctggctccacgtctggcagcacggcctcctgacaatctctgggctccgaggcgtggggacgaggctgatttattattgctgttcattatgccggtnagttagtggccgtaagggtgttcgggcggagggaccgaaggtcgaccgtcgtaggtcagcccgaaggcctcgccccgtggtcc

SEQ ID NO: 168643 - DNA, 164 bp, Homo sapiens; identical to SEQ ID NO: 168239
  misc_feature: GYAE6OF02GAVIN.49.82.H05.1.454.CMB.1.raw
  modified_base (164)..(164): a, c, t, g, unknown or other
  misc_feature (164)..(164): n is a, c, g, or t

SEQ ID NO: 168644 - DNA, 502 bp, Homo sapiens
  misc_feature: GYAE6OF02GWEFD.49.82.H05.1.454.CMB.1.raw
  modified_base (253)..(253): a, c, t, g, unknown or other
  misc_feature (253)..(253): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaaccttttntcctggttaccaactaacaccccaggcaaaagccccccaaaactcaatcatttatgaggccgatcagcggccctcaggggtctctgatcgcttctctggctccacgtctggcagcacggcctcccgtgacaatctctgggcctccaggctggggacgaggcttgattattattgctgttcatatgcgtgatgngcgaaggtgtcggngaggacaggtgacgtcgtagcagccaagctcgcccctggtcc

SEQ ID NO: 168645 - DNA, 501 bp, Homo sapiens
  misc_feature: GYAE6OF02GPZYU.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaatcatcatttatgaggccgatcagcggccctcaggggtctctgatcgcttctctggctccacgtctgcagcacggcctccctgacaatctctgggctccaggctggggacaggctgattattattgctgttcatatgcgtgatagtggcgaaggtgtcggcggaggacgaggtcgaccggtctaggtcacgccgaaggcctcgcccctggtacc

SEQ ID NO: 168646 - DNA, 527 bp, Homo sapiens
  misc_feature: GYAE6OF02HT6ZN.49.82.H05.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
  modified_base (419)..(419): a, c, t, g, unknown or other
  misc_feature (419)..(419): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacaccaggcaaagccccaaactcatcatttangagccgatcagcggccctcgagggtctctgatcgcttctctggcctccacgtctggcagcaccggcctccctgacaatctcgtggctcgaggcgtggggacgaggctagatttattagttgntgttcattatgccgtagattaggtcggacgtaaggggtgttcgggcgggacgggtaccgaagggtcgtaccgtcgtaggtcacgccgaaggcctcggccccctggtcc

SEQ ID NO: 168647 - DNA, 544 bp, Homo sapiens
  misc_feature: GYAE6OF02GFN0W.49.82.H05.1.454.CMB.1.raw
  modified_base (322)..(322): a, c, t, g, unknown or other
  misc_feature (322)..(322): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccccaggcaaagcccccaaactcatcatttatgaggccgatcagcggccctnaggggtctctgatcgcttctctggctcacgtctggcagcacggcctccctgacaatctctgggctcgaggcgtggggacgaggctgattattattgcttgttcatatcgccggtgagttaggtcggacggtaagggtcgttcgggacgggaacgggaccgtaagggtcgaccggtccgtaggtaccgacgcccgaacggcctaccggcccccgtggtacccg

SEQ ID NO: 168648 - DNA, 584 bp, Homo sapiens
  misc_feature: GYAE6OF02F5L4W.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcgacgggtctctgatcgcttctctggctccacgtctggcagcacggcctcctgacaactctcgtcggctccgaggcgtggggacgaggctgatttattattgtcttgttcattagtcgtccggtgtaacgttacggtgggtaccggtaaggggttcggttccgggacgggtaacggggaacgtaaaggggttcggaacccggttccgttacgggtaccgacggaccccgtaaagggtcccgtaccggccccccgttcggtacccg

SEQ ID NO: 168649 - DNA, 516 bp, Homo sapiens
  misc_feature: GYAE6OF02IREK6.49.82.H05.1.454.CMB.1.raw
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (421)..(421): a, c, t, g, unknown or other
  misc_feature (421)..(421): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctggtaccaacaacacccaggcaaagcccccaaatcatcatttangagcgatcagcggcctnagggtctctgatcgcttctctggctccacgtctggcagcacggcctcctgacaatctctgggctccgaggcgtaggggacgaggctagtattattagttgctgttnatatcgcggtgatagtgggccgtaaggggtgttacgggngggaggaccgaaggtcgaccggtcgacggtcacggcccgaggctcgcccctggtcc

SEQ ID NO: 168650 - DNA, 540 bp, Homo sapiens
  misc_feature: GYAE6OF02GZ2VZ.49.82.H05.1.454.CMB.1.raw
  modified_base (299)..(299): a, c, t, g, unknown or other
  misc_feature (299)..(299): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaagcccccaaactcatcatttangaggccgatcagcgccctcaggggtctctgatcgcttctctggctccacgtctggcagcacggcctccctgacaatctctggctcaggctggggacaggctgtattattattgctgttcatatggtccggtgacttaggtcggaccggtaaagggttgttacgggcgggacgggaccgaacgggtcgacccgtccgtaggtcctacggcccgaaggccgtccggacccccgtcggtacccg

SEQ ID NO: 168651 - DNA, 173 bp, Homo sapiens
  misc_feature: GYAE6OF02G169W.49.82.H05.1.454.CMB.1.raw
  modified_base (173)..(173): a, c, t, g, unknown or other
  misc_feature (173)..(173): n is a, c, g, or t
tcagagtcgagagacacgaccggtgctcgatttagtcgagctctctcgcgggcacgaccggtgctcgatttagtcgagctctctcgcgggcacgaccggtgctcgatttagacgtcttcagtcttcccgccatctgatctctcgactctgagcgggctggcaaggcgcatagn

SEQ ID NO: 168652 - DNA, 213 bp, Homo sapiens
  misc_feature: GYAE6OF02G1D6P.49.82.H05.1.454.CMB.1.raw
  modified_base (211)..(213): a, c, t, g, unknown or other
  misc_feature (211)..(213): n is a, c, g, or t
tcagagtcgagagacacgaccggtgctcgatttagtcgagctctctcgcgggcacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 168653 - DNA, 185 bp, Homo sapiens
  misc_feature: GYAE6OF02HBTGY.49.82.H05.1.454.CMB.1.raw
  modified_base (167)..(185): a, c, t, g, unknown or other
  misc_feature (167)..(185): n is a, c, g, or t
tcagagtcgagagacacgaccggtgctcgatttagtcgagctctctcgcgggcacgaccggtgcgtcgatttagtcacgcgagaaagggaaagggggctggccctgacgtgtttctgttcccaccctcctctctctcgactctgagcgggctggcaaggcgcatagnnnnnnnnnnnnnnnnnnn

SEQ ID NO: 168654 - DNA, 178 bp, Homo sapiens
  misc_feature: GYAE6OF02JCNU7.49.82.H05.1.454.CMB.1.raw
  modified_base (173)..(178): a, c, t, g, unknown or other
  misc_feature (173)..(178): n is a, c, g, or t
tcagagtcgagagacacgaccggtgctcgatttagtcgagctctctcgcgggcacgaccggtgctcgatttagtcgagctctctccgcggcacgacggtgctcgatttagacgtcttcagtcttccgccaagtctgatctctcgactctgagcgggctggcaaggcgcatagnnnnnn

SEQ ID NO: 168655 - DNA, 205 bp, Homo sapiens
  misc_feature: GYAE6OF02F8GEW.49.82.H05.1.454.CMB.1.raw
  modified_base (201)..(205): a, c, t, g, unknown or other
  misc_feature (201)..(205): n is a, c, g, or t
tcagagtcgagagacacgaccggtgctcgatttagtcgagctctctcgcgggcacgaccggtgctcgatttagtcgagctctctcgcgggcacgaccggtgctcgatttagtcacgcgagaaagggaagggctggccctgacgtgtttctgtttccgccctcctctctctcgactctgagcgggctggcaaggcgcatagnnnnn

SEQ ID NO: 168656 - DNA, 166 bp, Homo sapiens
  misc_feature: GYAE6OF02FSUB5.49.82.H05.1.454.CMB.1.raw
  modified_base (165)..(166): a, c, t, g, unknown or other
  misc_feature (165)..(166): n is a, c, g, or t
tcagagtcgagagacacgaccggtgctcgatttagtcgagctctctcgcgggcacgaccggtgctcgatttagtcacgcgagaaagggaagggggctggccctgacgtgtttctgttcccaccctcctctctctcgaatctgagcgggctggcaaggcgcatagnn

SEQ ID NO: 168657 - DNA, 553 bp, Homo sapiens
  misc_feature: GYAE6OF02IQMXR.49.82.H05.1.454.CMB.1.raw
  modified_base (298)..(298): a, c, t, g, unknown or other
  misc_feature (298)..(298): n is a, c, g, or t
  modified_base (491)..(491): a, c, t, g, unknown or other
  misc_feature (491)..(491): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactgaaaccagcagtgatgttgggaattataaccttttctcctggtaccaacaacaccaggcaaagcccccaaatcatcatttangagcgatcagcgcctgacgggtctctgactcgcttctctggctccacgtctggcagccacggtccctccgtgactaactctcgtcgggacctccgagggccgtggggaaccgagggctaggtatttattattgcttgttcagttacgtcgtccggtgtagttacggtagggccgtaaggggttcgttccgggngggtagggtacgaagggtccgaccgttcgaggtcacgccgagcgtccgtaccccgtggtacc

SEQ ID NO: 168658 - DNA, 534 bp, Homo sapiens
  misc_feature: GYAE6OF02FLK86.49.82.H05.1.454.CMB.1.raw
  modified_base (301)..(301): a, c, t, g, unknown or other
  misc_feature (301)..(301): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttangaggccgatcagcgccctgaggggtctctgatcgcttctctggctccacgtctggcagcacggcctcctgacaatctcgtgggctccgaggcgtggggacgaggctgatttattagttgcttgttcatatgccggtgagttaggtggaccggtaagggtcgttcgggacggagggaccgtaaggtcggacccgtcgtacggtcacggcccgaaggcctcggaccccctggtcc

SEQ ID NO: 168659 - DNA, 250 bp, Homo sapiens
  misc_feature: GYAE6OF02HCI08.49.82.H05.1.454.CMB.1.raw
  modified_base (247)..(250): a, c, t, g, unknown or other
  misc_feature (247)..(250): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggttggggaagaggaagactgacggtcccccaggagttcaggtgctgggcacagcggccctgggctgcctggtcaaggactacttcctctctcgactctgagcgggctggcaaggcgcatagnnnn

SEQ ID NO: 168660 - DNA, 201 bp, Homo sapiens; identical to SEQ ID NO: 168639
  misc_feature: GYAE6OF02FTO0X.49.82.H05.1.454.CMB.1.raw
  modified_base (198)..(201): a, c, t, g, unknown or other
  misc_feature (198)..(201): n is a, c, g, or t

SEQ ID NO: 168661 - DNA, 685 bp, Homo sapiens
  misc_feature: GYAE6OF02I631U.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctcctggtaccaacaacacccaggacaaacgccccaaactcatcatttatgagccatcagcgccctcgagggtctctgatcgcttctctggcctccacgtctggcacgccgaccggccctcccgtagacctaactcctacgtcgggccttacccgagggtccgtgggggaaccgagggtccttaggtaacttttagtttaacgttggtcctttacggtttacctaagttacgttcgggtacccgggttaggtaacgttacgggttcggggaacccgggtaaagggggtttcggttaccggggacggggtaaggggtaaccggtaaaacggggttccgggtaaccccggttacccgttaaggggtaccctaacggggtacccccgtaaacggggtcccgttaccccgggtcccccccggttacgggttaccccg

SEQ ID NO: 168662 - DNA, 623 bp, Homo sapiens
  misc_feature: GYAE6OF02H21YT.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactgaaaccagcagtgatgttaggaattataacctttctcctgtacaacaacaccagacaacgccccaaatcatacatttatgacggccactcacgcgtccctcgacggggtctctgtactcgtccttctcgtcggcctcccgtacgtctcggcacgccgaccggcctccctgaacaactctccgtcggccctaccgaggtccggtacggggacgacggcgtagtatttattacgttgtcgttgttcagttatcggtcccggtagagttacggtcgggtacggtaacgggttcgggttacgggacgggtaacggggtaaccggtaagggtccggtacccggttaccggtaacggtaccggacggtaccccggaacggtcccgtaccggtcccccccgtggttaccccg

SEQ ID NO: 168663 - DNA, 534 bp, Homo sapiens
  misc_feature: GYAE6OF02JTW9H.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataactttctctgtaccaacacaccagacaacgccccaaactcatcattatgagtccatcagccggccctgagggtctctgatcgtcttctctcggctccgacgtctggcagcacgcctcctgacactctcgcgggctccgaggtcgtcggggacgtaggtcgttgtacgtttatttagtcgtctcgttctaatacgttcggcggttagtagtaggtcgggaccgtaaggggttgtacgggcggtaagggacaagggtcacgtcgaggtcacggccagtcctcggccctcgtc

SEQ ID NO: 168664 - DNA, 517 bp, Homo sapiens
  misc_feature: GYAE6OF02GRFHX.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagcccccaaactcatcatttatgaggccgatcagcggccctcaggggtctctgatcgcttctctggctccacgtctggcagcacggcctccctgacaatctctgggctccgaggcgtggggacgaggctgattattattgcttgttcatatgccgtgtatagtggcgtaagggtgttcggcggagggaccgaagggtcgaccgtcgtaggtcacggccgaaggcctcgtcccctggtccc

SEQ ID NO: 168665 - DNA, 673 bp, Homo sapiens
  misc_feature: GYAE6OF02IP41U.49.82.H05.1.454.CMB.1.raw
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttcncctgtaccaacaacacccaggcaaacgccccaaactcatcatttatgaagccgatcagccgcctcgagggtctctgactccgtcttctcgtcggccttcccgacgttctgggcacggccgaccggtccctcccgtgaactaacgttcctccgtcgggtccctaccgacgggccgttcggggaaccggacggtacgtagtaacgtttagttaagttcgtcttacgtttactaagttaacgttcggtaccggttaggtaacgttacgggttcgggtacccggttaaagggggtttttccggggacggggtaaccgggtaaccggtaacgggttaccggttacccggttaccggtaacgggttaccgacgtaaccccggtaacggtcccgttacccggtcccccggttacggtcccttaacccgg

SEQ ID NO: 168666 - DNA, 166 bp, Homo sapiens; identical to SEQ ID NO: 168291
  misc_feature: GYAE6OF02F29SW.49.82.H05.1.454.CMB.1.raw
  modified_base (166)..(166): a, c, t, g, unknown or other
  misc_feature (166)..(166): n is a, c, g, or t

SEQ ID NO: 168667 - DNA, 572 bp, Homo sapiens
  misc_feature: GYAE6OF02IFVWK.49.82.H05.1.454.CMB.1.raw
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactgaaaccagcagtgatgttggaattataaccttttctcctggtaccaacaacacccaggcaaacgccccaaactcatcatttangagccgatcagcgcctcgagggtctctgatcgcttctctggctccacgtctggcngcacggcctcctgacatctcgtggctcgaggcgtggggacgnggctgtattattattgcttgttcaagttagtcgccgggttgagttaggtcggggaccggtaaggggttcggtttacgggacgggtaaggggtacgaaaggggttccggacccggttaccgtaacgggtcccgaacggccccgtaagggccccgttacggccccccgttaggtacccg

SEQ ID NO: 168668 - DNA, 564 bp, Homo sapiens
  misc_feature: GYAE6OF02IEQ79.49.82.H05.1.454.CMB.1.raw
  modified_base (252)..(252): a, c, t, g, unknown or other
  misc_feature (252)..(252): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttntcctggtaccaacaacacccaggcaaagcccccaaactcatcatttatgagcgatcagcgcctcgagggtctctgatcgcttctctggctccacgtctggcagcacgacctcctgacatctcgtggctcgaggcgtggggacaggctgtattattattgcttgtctatagtcgccggtgagttaggtggaccggtaaggggttcgttacgggacgggtaagggaacggtaaacgggtacggtaacccggtccgttaacgggtccgacggacccgtaacgggtcccgttccggtcccccccgtgggttacccc

SEQ ID NO: 168669 - DNA, 632 bp, Homo sapiens
  misc_feature: GYAE6OF02ITZZC.49.82.H05.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctctgtaccaacaacaccaggcaaacgccccaaactcatcatttangagccgatcagcgcctnacgggtctcgtgatcgcttctctggctcacgtcgtgcagcacggtcctccgtgacaactctcgtagggcctcgaggtcgtaggggacgaggtctgtatttagttattcgcttgttctaagttacgtcggtaccgggtagtacgttacgggtcgggtaccggtaaaggggtttcgggttaccgggacggggtaacggggaaccgtaaaacggggttcccggtaacccgggtttacccgtaacggggtttacccgaacgggtaccccggtaaacggggtacccgttcccgggttacccccccggttacggggtttaaccccg

SEQ ID NO: 168670 - DNA, 251 bp, Homo sapiens; identical to SEQ ID NO: 168296
  misc_feature: GYAE6OF02H087K.49.82.H05.1.454.CMB.1.raw
  modified_base (248)..(251): a, c, t, g, unknown or other
  misc_feature (248)..(251): n is a, c, g, or t

SEQ ID NO: 168671 - DNA, 252 bp, Homo sapiens
  misc_feature: GYAE6OF02I281O.49.82.H05.1.454.CMB.1.raw
  modified_base (250)..(252): a, c, t, g, unknown or other
  misc_feature (250)..(252): n is a, c, g, or t
tcagagtcgagagacacgaccggtgctcgatttagtcgagctctctcgcgggcacgaccggtgctcgatttagtcgagctctcccgcgggcacgaccggtgctcgatttagtagcatactgttgggtttgggggaagaggaagactgacggtccccccaggagttcaggtgctgggcacagcggccctgggctgcctggtcaaggactacttcctctctcgactctgagcgggctggcaaggcgcatagnnn

SEQ ID NO: 168672 - DNA, 582 bp, Homo sapiens
  misc_feature: GYAE6OF02HZ7PR.49.82.H05.1.454.CMB.1.raw
  modified_base (325)..(325): a, c, t, g, unknown or other
  misc_feature (325)..(325): n is a, c, g, or t
tcagagtcgagagacacgaccggtgctcgatttagtcgagctctctcgcgggggggtcacaagaggcagcgctctcgggacgtcgccaccatggcctgggctctgctgctcctcactctcctcactcaggacacagggtcctgggcccagtctgcccctgactcagcctgcctccgtgtctgggtctcctggacagtcgatcaccatctcctgcactgaaaccagcagtgatgttggaattataacctttctcctgtaccaacaacacccaggcaaagcccccaaactcatcatttatgaggccatcagcgccctcgagggtctntgatcgcttctctggcctccacgtctggcacgccacggccctccctagaaccaatcctcgtcgggcctccgaggcgtagggggaccgaggctagtatttattattgtccttgttcatagtcggtccggtagagttagtagggccggtaaaggggttgttccgggaggggagggtaaccgaaagggttcggtaacccggttccgtaaggtccacggccccgaaagggtcccgtacccggtcccccctacgggttaccc

SEQ ID NO: 168673 - DNA, 609 bp, Homo sapiens
  misc_feature: GYAE6OF02IHFB2.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatgttagggaattataaaccttttctcctggtaaccaaacaacacccaaggcaaacgcccccaaactcatcatttatgacggcgaatcagccggccctcgagggtctcgtgatcgtcttctctcggctccgacgtcgtgctacgcacggccctccctgacaactcctacgtcggcctccgaggtcggtcggggacgaggtctgtattagttattcgcttgttacattagtcggtccggtgtacgtaggtcgggaccggtaaggggttcggttaccggggacgggtacgggaaccggaacggttacggacccggttaccgtacggtacgacggtacccgtaaacgggtcccgtacccggtccccccgttacggtacccg

SEQ ID NO: 168674 - DNA, 136 bp, Homo sapiens
  misc_feature: GYAE6OF02JPFMW.49.82.H05.1.454.CMB.1.raw
  modified_base (107)..(108): a, c, t, g, unknown or other
  misc_feature (107)..(108): n is a, c, g, or t
  modified_base (110)..(110): a, c, t, g, unknown or other
  misc_feature (110)..(110): n is a, c, g, or t
  modified_base (112)..(114): a, c, t, g, unknown or other
  misc_feature (112)..(114): n is a, c, g, or t
  modified_base (117)..(118): a, c, t, g, unknown or other
  misc_feature (117)..(118): n is a, c, g, or t
  modified_base (120)..(120): a, c, t, g, unknown or other
  misc_feature (120)..(120): n is a, c, g, or t
  modified_base (122)..(136): a, c, t, g, unknown or other
  misc_feature (122)..(136): n is a, c, g, or t
tcagagtcgagagacacgaccggtgctcgatttagtcgagctctctcgcgggcacgaccggtgctcgatttagtcgagctctctcgcgggctggcaaggcgcatagnngngnnnagnnangnnnnnnnnnnnnnnn

SEQ ID NO: 168675 - DNA, 509 bp, Homo sapiens
  misc_feature: GYAE6OF02GDW9E.49.82.H05.1.454.CMB.1.raw
  modified_base (504)..(504): a, c, t, g, unknown or other
  misc_feature (504)..(504): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaaccttttctcctggtaccaacaacacccaggcaaagcccccaaactcatcatttatgaggccgatcagcggccctcaggggtctctgatcgcttctctggcctcacgtctggcagcacggcctccctgacaatctctgggctcaggcgtggggacgaggctgattattattgctgttcatatgccggtgatagtggcgaagggtgttcgggcggagggaccgaaggtcgaccgtctaggtcagcccgaggctcgccccnggtcc

SEQ ID NO: 168676 - DNA, 560 bp, Homo sapiens
  misc_feature: GYAE6OF02G8AFZ.49.82.H05.1.454.CMB.1.raw
  modified_base (415)..(415): a, c, t, g, unknown or other
  misc_feature (415)..(415): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctgtaccaacaacaccagacaaacgcccccaaactcatcatttatgacggccgatcagccggccctcgagggtctctgatcgcttctctggcctccacgtcgtggcagccaccggccctccctgacaactcctcgtcgggcctccgaggcgtggggacgnggctgatttattattgtctgttcattagtgtccggtgtagttaggtcgggaccggtaagggttcgtacgggacgggaaggacgtaaagggtccgtaccggtacgtaggtcacggacccgaaggtccgtccggtccccgtggtacc

SEQ ID NO: 168677 - DNA, 521 bp, Homo sapiens
  misc_feature: GYAE6OF02HGDBO.49.82.H05.1.454.CMB.1.raw
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaacgcccccaaactcatcatttatgaggccgatcagccggccctcgagggtctctgatcgcttctctggctcacgtctgcagcacggccctcctgaccaatctcgtggctccgaggcgnggggacgaggctgtattagttattgctgttcatatgcggtnagtgtggcgaagggtgttcgggcggagggacgaaggtcgaccggtccgtaggtcacggcccgaaggctccgcccccgtggtacc

SEQ ID NO: 168678 - DNA, 563 bp, Homo sapiens
  misc_feature: GYAE6OF02G828B.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcagccggccctcgaggggtctctgatcgcttctctggctccacgtctgcagcacggcctcctgacatctcgtgggctccgaggcgtggggacgaggctgtatttattattgcttgttcagttatcggaccggttgattaggtcgggaccggtaaggggttcggttagggtgggaagggtaacgtaaagggttcggaacccggttccgttaagggtcacggcccgaagggtcctcccggcccccgttcgggtcc

SEQ ID NO: 168679 - DNA, 623 bp, Homo sapiens
  misc_feature: GYAE6OF02JMEJI.49.82.H05.1.454.CMB.1.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggaccagtcgatcaccatctcctgcactagaaaccagcagtgatgtaggaattataactttctctgtaccaanaacaccagacaacgccccaactccancatttangagccatacacgcgccctcagggtctctgatcgcttctctgctccacgtctggcagcaccggtccctccgtcgactaactccgtcgtcgggcctccgacgggctggggaccgtagggcttggtaatttacgttnttacgtcttgtttaccagttacgtggtcccggttagttacgttaagggtccgggtaaccgggtaaggggttcgtttcccggggacgggaaacggggacccggttaacgggttcggtaacccggttacccggtaaggttcccgtaacgggcccgtaaacgggtcccgtccggtccccccggttacggtaccccg

SEQ ID NO: 168680 - DNA, 111 bp, Homo sapiens
  misc_feature: GYAE6OF02H9H9Q.49.82.H05.1.454.CMB.1.raw
  modified_base (111)..(111): a, c, t, g, unknown or other
  misc_feature (111)..(111): n is a, c, g, or t
tcagagtcgagagacacgaccggtgctcgatttagtcgagctctctcgcgggcacgaccggtgctcgatttagtatctgatagttgggagcgggctggcaaggcgcatagn

SEQ ID NO: 168681 - DNA, 583 bp, Homo sapiens
  misc_feature: GYAE6OF02HOESC.49.82.H05.1.454.CMB.1.raw
  modified_base (250)..(250): a, c, t, g, unknown or other
  misc_feature (250)..(250): n is a, c, g, or t
  modified_base (368)..(368): a, c, t, g, unknown or other
  misc_feature (368)..(368): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgtggaattataacctttntcctggtaccaacaacaccaggcaaacgccccaaactcatcatttatgaggccgatcagccggccctcaggggtctctgatcgcttctctggctccacgtctggcagcacggcctccngacaatctcgtggctcgaggcgtggggacgaggcttgtattattattgtctgttcattacgtggccgggttagagttaggtcgggtaccggtaaggggttcgggttccgggacgggtaacggggacccgtaaaggggtccggtaacccggttacccgtagggtacccgacggtaccccgaaagggtccctccggtaccccccgttcggttacccg

SEQ ID NO: 168682 - DNA, 584 bp, Homo sapiens
  misc_feature: GYAE6OF02F8194.49.82.H05.1.454.CMB.1.raw
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtgattataactatgtctcctggtaccaacagtacccaggcaaacgcccccagactcatgatttangcggtcagtaagcggccctcgacggggtccctgactcgctttctctgctcgaagtctggaccaacgaccggccctcccgtcgtaccgtcctcgtcgggtccgtccgggtcgtagaagagtggaggtcgtgtatttatttcgtcgtcacgtctctatagtcgcgacggacgacgactaaacttaagtagttttttttttttagagttaggttcgggtacgggtacgggaaccgaacgacgtacggtaccggttaccgtacggtaccgaccgtaccgtaaccgg

SEQ ID NO: 168683 - DNA, 550 bp, Homo sapiens
  misc_feature: GYAE6OF02G8SD4.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctctgtaccaacaacaccaggcaaagccccaaactcatcatttatgagccgatcagccgccctcgagggtctcgtgatcgcttctctggctccacgtctggcagcaccggccctccctgactaatcctcgtgggctcccgaggtcgtggggacgaggcttaggatttattattgcttgttcatagtcggccgttgagttggtcgggaccgtaaggggtcgttcgggacgggaagggaacgaaagggtcgaacccggtcgtaaggttccaggcccgaaggcccgtcgtcccccgtggtacc

SEQ ID NO: 168684 - DNA, 222 bp, Homo sapiens
  misc_feature: GYAE6OF02HADP5.49.82.H05.1.454.CMB.1.raw
  modified_base (221)..(222): a, c, t, g, unknown or other
  misc_feature (221)..(222): n is a, c, g, or t
tcagagtcgagagacacgaccggtgctcgatttagtcgagctctctcgcgggctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 168685 - DNA, 518 bp, Homo sapiens
  misc_feature: GYAE6OF02F72J0.49.82.H05.1.454.CMB.1.raw
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
tcagagtcgagagacacgaccggtgctcgatttagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcggccctcaggggtctctgatcgcttctctggctccacgtctggcagcacggcctcccngacaatctctgggctccaggctgggacgnggctgatttattattgtctgttcatatgtccgtgagtgtcggcgtaagggtgttcggcggagggaccgaagggtgaccggtaccgtaggtcgacgccgaaggcctcgcccccgtcggtcc

SEQ ID NO: 168686 - DNA, 563 bp, Homo sapiens
  misc_feature: GYAE6OF02FMTH9.49.82.H05.1.454.CMB.1.raw
  modified_base (400)..(400): a, c, t, g, unknown or other
  misc_feature (400)..(400): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctctggtaccaacaacaccaggcaaagcccccaaatcatcattatgaggccgatcagccggccctcgagggtctctgatcgcttctctggctccacgtctggcagccacggtccctccctgacaatctcgtggctcgaggcgtgggacgngctgatttattagttgcgttgttcagttagtcggtaccgttagtacgttagggtcgggacggtaaggggttcgttcggggcgggaaggggaccgtaaagggtcggtaacccggtccgttagggtcgacggacccgaaggtccgtcccgcccccgttcggtacc

SEQ ID NO: 168687 - DNA, 213 bp, Homo sapiens; identical to SEQ ID NO: 168626
  misc_feature: GYAE6OF02IHDSW.49.82.H05.1.454.CMB.1.raw
  modified_base (211)..(213): a, c, t, g, unknown or other
  misc_feature (211)..(213): n is a, c, g, or t

SEQ ID NO: 168688 - DNA, 601 bp, Homo sapiens
  misc_feature: GYAE6OF02GEIHY.49.82.H05.1.454.CMB.1.raw
  modified_base (422)..(422): a, c, t, g, unknown or other
  misc_feature (422)..(422): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctcctggtaccaacaacacccaggacaaacgcccccaaactcatctattatgacggccgatcaggccgccctgagggtcctcgtgactcgcttctctggcctccgacgtctggcagccaccggccctcctagacctaatcctcgtcgggctccgaggtcgtaggggacgnggctagtattattattgcttgttacatagtcggtcggtgtagtaggtcggtaccggtaagggttcggttcggggacgggaggggtaacgtaaacgggtaccggtaacccggttaccgttaacgggttaccaaccggtaccccgtaagggcccttcccggtccccccgttaggtaccccg

SEQ ID NO: 168689 - DNA, 622 bp, Homo sapiens
  misc_feature: GYAE6OF02HMV3N.49.82.H05.1.454.CMB.1.raw
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctggcccagtctcgccctgactcagcctgcctccgtgtctgggtctctggacagtcgatcaccatctctgcactagaaaccagcagtgatggttagggaattactaaccttttctcctggtaaccaacaacaccagacaaacgaccccaaactcatctatttactagacgccgatcacggccgcctcgacgggtctctgtactcgtcttctcgtggcctccgacgttcgtggacacgcgaccggtcctacccgagacaactctacgtcggccttcgaggtcggtggggacgagtcgtagtacgtttaattagttcgtcttagttactagttacgtcggtccggtagtagttaggtacgggaccggttaaagggttcgggttacgggacggggtaacgggaacggtaaacggtacggtacccggttacgtaacggtccgaacggtcccgaaacggtccgtacccggtccccgtacggtaccc

SEQ ID NO: 168690 - DNA, 525 bp, Homo sapiens
  misc_feature: GYAE6OF02IHTLN.49.82.H05.1.454.CMB.1.raw
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctgtaccaacaacacccaggcaaagcccccaaactcatcatttatgagccatcagcgccctgagggtctntgatcgcttctctggctccacgtcnggcagcacggcctccctagacatctcgtggcctcgaggcgtggggacgaggctagtattattattgcttgttcattagtgccgtgatagtcggaccggtaagggttgttcgggcggaggacgaaggtcgaccggtacgtaggacgacgcccgaaggtccgtcgtcccccgtggtacc

SEQ ID NO: 168691 - DNA, 542 bp, Homo sapiens
  misc_feature: GYAE6OF02IJPXF.49.82.H05.1.454.CMB.1.raw
  modified_base (301)..(301): a, c, t, g, unknown or other
  misc_feature (301)..(301): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (476)..(476): a, c, t, g, unknown or other
  misc_feature (476)..(476): n is a, c, g, or t
tcagagtcgagagacacgaccggtgctcgatttagtcgagctctctcgcggggggtcgacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccatctcctgcactgaaacccagccagtcgatgttgggaattataaccttttctctggtaccaacaacacccaggcaaacgccccaaactcatcatttangtagccgatcgagaccggtccctcgacggggtctcctggatccgccttctcgtggcctccacgtctagtcagccacggcctcccngacatctctcggctccaggcgtgggacnggctgtattatntgtctgttnacttatcgacggtnacgtagtggtaccgaagggttgtcggnggacggagtaaacgggtcaccgtcgtaaggtcgtacgcccgtaaggctaccggcccctacggtccg

SEQ ID NO: 168692 - DNA, 251 bp, Homo sapiens; identical to SEQ ID NO: 168238
  misc_feature: GYAE6OF02IFGMW.49.82.H05.1.454.CMB.1.raw
  modified_base (249)..(251): a, c, t, g, unknown or other
  misc_feature (249)..(251): n is a, c, g, or t

SEQ ID NO: 168693 - DNA, 538 bp, Homo sapiens
  misc_feature: GYAE6OF02J07EJ.49.82.H05.1.454.CMB.1.raw
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (363)..(363): a, c, t, g, unknown or other
  misc_feature (363)..(363): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccaggcaaagccccaaatcancatttangagccgatcagcggccctgagggtctctgatcgcttctctcggctccacgtctggcagcacggcctccngacctatctcgtgggctcgaggctaggggacgaggctgtacttattactgtcttggttcaagttacgtcggtccggtataagttaggtcggacggtaagggttcgttcgggacgggtaggacgaagggtcgaccggttcgaggtcacggccgaagtccgtccgccccgtggtacc

SEQ ID NO: 168694 - DNA, 570 bp, Homo sapiens
  misc_feature: GYAE6OF02G42Y8.49.82.H05.1.454.CMB.1.raw
  modified_base (223)..(223): a, c, t, g, unknown or other
  misc_feature (223)..(223): n is a, c, g, or t
  modified_base (356)..(356): a, c, t, g, unknown or other
  misc_feature (356)..(356): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacacccaggcaaagcccccaaactcatcatttatgaggccatcagcggccctcgaggggtctctgatcgcttctctggctccacgtctgcngcacggcctcctgacatctctggctccgaggcgtggggacgaggctgtatttattagttcgcttggttctattacgtcgtccggtgtagttagggtcgggaccggtaaaggggttggttccgggacgggtacggggtaacgaaagggttcggaacccggttccgtaacgggtccgacggcccgaagggcccttaccggcccccgtggtaccccg

SEQ ID NO: 168695 - DNA, 623 bp, Homo sapiens
  misc_feature: GYAE6OF02JAO42.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaacgcccccaaactcatcatttatgaggccgatcagccggccctgaggggtctctgatcgcttctctcggctccgacgtctcggcagcaccggccctcccgtgacaactcctcgtcgggcctccgaggccgtgggggaccgacgggtcttgtatttattacgttcgcttgttcattagtcggtccggttagacgttaggtcgggtaccggtaaggggttcggttaccggggccgggaaggggtaacccgtaaggggttacggtaaccccggttccggtaacgggttcccgaacggtaccccggtaaagggtcccgtacccggtacccccccgttacggggttacccc

SEQ ID NO: 168696 - DNA, 542 bp, Homo sapiens
  misc_feature: GYAE6OF02H77IS.49.82.H05.1.454.CMB.1.raw
  modified_base (396)..(396): a, c, t, g, unknown or other
  misc_feature (396)..(396): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaagcccccaaactcatcatttatgaggccgatcagccggccctcgaggggtctctgatcgcttctctcggctccacgtctggcagcacggcctccctgacaatctctggctcgaggcgngggacgaggctgtattattagttgtcttgttcattatgccggtgagtaggtgggccgtaagggttcggtcggacgggaggaacgtaagggtcgaccggtaccgtaggtcgacggacccgaaggtccgtcggcccccgtggtacccg

SEQ ID NO: 168697 - DNA, 575 bp, Homo sapiens
  misc_feature: GYAE6OF02IP0N1.49.82.H05.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttncctgtaccaacaacaccagcaaagcccccaaatcatcatttangaggcatcagcggccctgagggtctctgatcgcttctctggcctccacgtctggcagccacggccccttccctagaccaactcgtcgtcgggctccgaggcgtggggacgaggctgattattattgctgttctatagtcgcggttagtagtaggttgggaccggtaaggggttggttaccgggcgggtaaggggtaacggtaaagggttaccgggaacccgttccgttacgggtaccgacggacccgtaaagggcctccggtaccccccgttggtacccg

SEQ ID NO: 168698 - DNA, 570 bp, Homo sapiens
  misc_feature: GYAE6OF02IOUFT.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgacggccgatcagccggccctcgaggggtctcgtgatcgtcttctctcggctccacgtctggcagcacgcctccctgacatctctgggctccgaggcgtggggacgaggctgtattattagttgctgttcattatcggccggtgtagttaggtcgggtacggtaaggggttggttcgggacgggaacggggacgtaaaggggtccggtaccggttccgtaacggtaccgacggacccgaaggcccgtccggtccccccgtcggtacccg

SEQ ID NO: 168699 - DNA, 548 bp, Homo sapiens
  misc_feature: GYAE6OF02GYXIK.49.82.H05.1.454.CMB.1.raw
  modified_base (317)..(317): a, c, t, g, unknown or other
  misc_feature (317)..(317): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcattatgagcatcagcggccctnacggggtctcgtgtactcgcgttctctcggctccacgtctggcagcacggcctccctgacaatctctggctccaggcgtggggacgacgcgtgtattattatcgctgttacattatcgtccggtgtactagtcgggaccgtaaagggtggttacggcggaagggaccgtaaggtcgtaccgtccgtaaggtcgacggacccgtaaggccgtacgccccccgttggtacccg

SEQ ID NO: 168700 - DNA, 612 bp, Homo sapiens
  misc_feature: GYAE6OF02GKJMM.49.82.H05.1.454.CMB.1.raw
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggattatacctttctctgtaccaacaacaccaggcaacgccccaactcatcatttangagccgatcagccggccctcgagggtctctgactcgccttctcgtggcctccgacgttcgtggcacggccaccggccctcccgtagacctaactcctcgtcgggcctcccgagggccgtgggggaccgaggcgttgatttattattgcttgttacattacgtcggtccggtagtacgttggtcgggaccggtaagggggttgttaccggggacgggaacggggtaaccggtaaagggttccggaaccccggttaccggttacgggtaccgaaccggaccccggtaagggtcccgtacccggccccccgttcggggtacccc

SEQ ID NO: 168701 - DNA, 578 bp, Homo sapiens
  misc_feature: GYAE6OF02I27UW.49.82.H05.1.454.CMB.1.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataactttcnctggtaccaacaacaccaggcaaacgccccaaactcatcatttatgaggccgatcagccggccctcgaggggtctcngatcgcttctctggctcacgtctggcagcacgcctcctgacaatctcgtggctcgaggcgtgggacgaggctagtattacttagttgtactgttcagttactcggtaccggtgtaagttaacgtcgggaccgtaaagggggttcggttccgggacgggaacggggtacgaaacggggttcgaccgggttacccgtagggtccgacggtccccgtaaagggtccgtacccggtcccccggtacggttacccg

SEQ ID NO: 168702 - DNA, 534 bp, Homo sapiens
  misc_feature: GYAE6OF02FIWN0.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcattatgagccgatcagccggccctcgaggggtctctgatcgcttctctggctccacgtctgcagcacggcctccctgacaatctctgggctccgaggcgtggggacaggctgatttattattgtctgttcatagtgccggtgagttagtggcggtaagggttcgttcgggacggagggaacgtaaagggtcggtaccgtccgtaggtcacggcccgaaggcctcgcccccgtggtaccc

SEQ ID NO: 168703 - DNA, 215 bp, Homo sapiens
  misc_feature: GYAE6OF02J3Q6E.49.82.H05.1.454.CMB.1.raw
  modified_base (206)..(215): a, c, t, g, unknown or other
  misc_feature (206)..(215): n is a, c, g, or t
tcagagtcgagagacacgaccggtgctcgatttagtcgagctctctcgcggcacgaccggtgctcgatttagagagagtgtgttgggttggggaagaggaagactgacggtcccccaggagttcaggtgctgggcacagcggcctggctgcctggtcaaggtctacttcctctctcgactctgagcggctggacaaggcgcatagnnnnnnnnnn

SEQ ID NO: 168704 - DNA, 507 bp, Homo sapiens
  misc_feature: GYAE6OF02JDDCF.49.82.H05.1.454.CMB.1.raw
  modified_base (398)..(398): a, c, t, g, unknown or other
  misc_feature (398)..(398): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaagcccccaaactcatcatttatgaggccgatcagcggccctcgaggggtctctgatcgcttctctggctccacgtctggcagcacggcctccctgacatctctggctccaggctggggacnggctgattattattgctgttcatatgcgtgagtgtggcgtagggtcgttcggcggaggaccgaggtcgaccgtccgtaggtcacggcccgaaggctcgccccgtggtcc

SEQ ID NO: 168705 - DNA, 580 bp, Homo sapiens
  misc_feature: GYAE6OF02IPJ03.49.82.H05.1.454.CMB.1.raw
  modified_base (298)..(298): a, c, t, g, unknown or other
  misc_feature (298)..(298): n is a, c, g, or t
  modified_base (434)..(434): a, c, t, g, unknown or other
  misc_feature (434)..(434): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctggtaccaacaacaccaggcaaacgccccaaactcatcatttangaggccatcagcgcctcgagggtctctgatcgcttctctggctccacgtctggcagcaccgcctccagaccaatccgtcgtcgggctcccgagggtcgtaggggacgacggtctgtatttagtttatgtctcgttntattagtcggcgttagagttaggcgggtaccggtaaaggggttcgttacgggacgggaagggtaaccgtaaaggggttccgaaccggttccgtaaggtccgacggtacccgaacggtccgtacccggtccccccggtggtaccccg

SEQ ID NO: 168706 - DNA, 790 bp, Homo sapiens
  misc_feature: GYAE6OF02GCC9U.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcccctcgtcgtcggtcggtcctcggtacgacgtacgtacgtactaccaacctacttcccttccgtcgacctacgtaaaccgaaaccgacgacgtagtagtagtttgggttaaggttaatttaaccttttaacctttcctcggttaccgtaaaccaaactaacccaccggacgaacaaacccccgaacccctaaactctaactacttaatttagaggaccggactactacgacggcccgtccctagggtacggttctcgtagtacgtccgttcttcctcggtcgtccctaccggtacgttcggacgacgaccgtacccggacccggttccccctacgacgtaaacctacttccgtcgggtccggtcctaccgggacgggttcgggtaacggggaccggtacggttacgttagttaattttacgttacgttcgttcgtttcttaactagttacggttcccgggtacgtaagttaggttacggggccgggtaaacggggttaggggtttccgggtaccgggacgggggtaaccggaaccgggttacgggtacccggtacccggttacggtacggtacacccggtacggtaccggtccgaccccccggttcccggtcgtacccg

SEQ ID NO: 168707 - DNA, 179 bp, Homo sapiens
  misc_feature: GYAE6OF02G0DSM.49.82.H05.1.454.CMB.1.raw
  modified_base (179)..(179): a, c, t, g, unknown or other
  misc_feature (179)..(179): n is a, c, g, or t
tcagagtcgagagacacgaccggtgctcgatttagtcgagctctctcgcggggctctctcgcgggcacgaccggtgctcgatttagtcacgcgagaaagggaaagggggctggccctgacgtgtttctgttcccaccctcctctctctcgactctgagcgggctggcaaggcgcatagn

SEQ ID NO: 168708 - DNA, 527 bp, Homo sapiens
  misc_feature: GYAE6OF02F0WZF.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattataaccttttctcctggtaccaacaacacccaggcaaacgcccccaaactcatcatttatgaggccgatcagccggccctcgagggtctctgatcgcttctctggctccacgtctggcagcacggccctcctgacaatctctgggctccgaggctggaggacgaggctgtatttattactgcagctacatataacaaactaataaactcgttagggtcgttcgggcggacggaaccaaacgtcgaccgtcctacgtcacgacccgaggcctccgcccctgtaccc

SEQ ID NO: 168709 - DNA, 581 bp, Homo sapiens
  misc_feature: GYAE6OF02I5S02.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaacgcccccaaactcatcatttatgaggccgatcagccggccctcgagggtctctgatcgcttctctgctccacgtctggcagcacggcctcctgacatctcgtggctccgaggcgtggggaccgaggcttagtatttattagttgtctgttacattatcggccggttagagttacggtgggtacccggtaaggggttcggttaccgggacgggtaacgggtacccggtaagggtccggacccggttaccggtaggtacccgacggacccgaaagggccctacccggccccccgtcggtacccg

SEQ ID NO: 168710 - DNA, 212 bp, Homo sapiens; identical to SEQ ID NO: 168241
  misc_feature: GYAE6OF02GTO8F.49.82.H05.1.454.CMB.1.raw
  modified_base (211)..(212): a, c, t, g, unknown or other
  misc_feature (211)..(212): n is a, c, g, or t

SEQ ID NO: 168711 - DNA, 523 bp, Homo sapiens
  misc_feature: GYAE6OF02F1DF9.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagccccccaaatcatcatttatgaggccgatcagcggccctcgagggtctctgatcgcttctctggctccacgtctgcagcacggcctcctgacatctctgggctcaggctggggacaggctgattattattgctgttcatatcgccggtgagttagtggccggtaagggttgttcgggcgggagggaccgaagggtcgacccgtccgtaggtcacggcccgaaggcctcgcccccgtggtaccc

SEQ ID NO: 168712 - DNA, 605 bp, Homo sapiens
  misc_feature: GYAE6OF02G9542.49.82.H05.1.454.CMB.1.raw
  modified_base (229)..(229): a, c, t, g, unknown or other
  misc_feature (229)..(229): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctcgggcccagtctcgccctgactcagcctgcctccgtgtcgtggtctccgtggacagtcgatccacatcctctgcactagaaaccngcagtgattggttaggtaatttaacttaaccttttctcctacggtaaccaaactaaccacccgaggaccaaaccgaccccaaactcatactatttanggacgctancgacgccgcctgacgggtctctgactcgtcttctcgtcgctccacgtcgtgcngccgaccgcctcnactatctcgnggctcgngcgtgggacgngtctagttacttattgtcgtattcgttatagttcgtcgggtcgtagtagcggttcgggaccggtaagggttcgtccgggagggtacgggaccgtaagggtccgtaccggttaccgaggttaccgaaccggtacccgtaacgggcccgttccccggttacccccgacggttaccccg

SEQ ID NO: 168713 - DNA, 707 bp, Homo sapiens
  misc_feature: GYAE6OF02IIO3A.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactgaaaccagcagtgatgttggaattataaccttttctcctggtaccaacaacaccaggacaaacgccccaaactcatactatttatgaggccgatcgacgccggccctcgacggggtctcgtcgatcgtcttcgtcgtcggcctccgtacgtcgtcggctacgccgaccggtccttcccgtagaacctaatccgtcgtcggggtccctccggaacgggtccggtaggggggaaccggtacgggtcgttaggttaattttaacgttttaacgttgtaccgttacggtttacgtaacgttaagtcgggtaccgggttaggtaagttacgggtacggggtaccgggttaaaggggtttcgggttaccggggaccggggtaaacggggtaaccggtaaaaacggggttccggtaacccggttaaccggttaacgggtaccgaaccggtaccccggtaaacggtcccggtacccggtccccccgttacggttacccg

SEQ ID NO: 168714 - DNA, 521 bp, Homo sapiens
  misc_feature: GYAE6OF02IMA8X.49.82.H05.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
  modified_base (427)..(427): a, c, t, g, unknown or other
  misc_feature (427)..(427): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctcctgtaccaacaacacccaggcaaagcccccaaactcatcatttangaggcgatcagcgccctgagggtctctgatcgcttctctggctccacgtctggcagcacggcctcctgacatctctgggctccaggctggggacgaggctgtattattattgctgttcatagtgccggtnagtagtggaccggaagggtgttcgggacggagggacgaaagggttcgacccggtcgtacggtcacggcccgaaggcctcgtcccccgtggtacc

SEQ ID NO: 168715 - DNA, 698 bp, Homo sapiens
  misc_feature: GYAE6OF02H2I5D.49.82.H05.1.454.CMB.1.raw
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataacctttntcctgtaccaacaacaccagacaaacgccccaaatcatacatttacngacgccgatcgacgcggaccctcgagggtctcgtgactcgtcttctcgtcggctccacgtctcggacacggcctaccggtcctaccccgtagtactaactccgtccgtcgggtaccttaccgaacgggtccggttacggggacgtaacggtccgttagttaagtttagtttaacgtttcgtcgtttacgttacgttaacgttaacgttcgggtaccgggttggtaacgtttaacgggttaccgggaaccgggtaaaggggtttcgggttaccggggaccggggtaacggggtaaccggtaaacgggttaccggtacccggtaaccggttaacgggtaccggtaccggtaccccggaacgggtacccgttcccggtaccccccggttacgggttaaccccg

SEQ ID NO: 168716 - DNA, 652 bp, Homo sapiens
  misc_feature: GYAE6OF02GPJT3.49.82.H05.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctcctggtaccaacaacaccaggacaaacgccccaaatcatcatttangacgcgatcagccggccctcgagggtctcgtgactcgtcttctctcggcctccgacgtctcggcagccgaccggtccctccgtgacctaactcctcgtcgggtcctccgaggcggtacggggacgaggtcgttaggtatttattagttgtccgttgttactaagttagtcggtaccgggtggtaagtttacgggtacgggtacccggtaaaggggttcgggttaccggggtacggggaacgggtaaccggtaaacggggttaccggtacccgggttaaccggttaacgggtacccgaacgggtaccccggtaaacgggtcccgtaccccggtccccccggttacgggttaccccg

SEQ ID NO: 168717 - DNA, 650 bp, Homo sapiens
  misc_feature: GYAE6OF02JS4LU.49.82.H05.1.454.CMB.1.raw
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgattggttaggtaattacttacctttctccgtacgtaaccaacaaccaccgagaccaaaccgaccccaaactcatctattagngacgcatcgacgccggccctcgacgggtctcgtgtactcgtcttctcgtcgcctccgacgtcgtcggcacgccgaccgtccctccgtagactactccgtcgcggtcctaccgacgggtcggtacgggacgtacggtcttagtatttacgttagttcgtcttgttactagttacgtcggtacgttaggtagttacgggtacgggtacgggtaagggtttcgggtacgggacgggtaacgggtaccggtaacgggttccggtaacccggttaccgtacgggtaccgaaccgggtacccggtacggttcccggtaccccggttcccccggtacggttacccg

SEQ ID NO: 168718 - DNA, 225 bp, Homo sapiens
  misc_feature: GYAE6OF02ISP8T.49.82.H05.1.454.CMB.1.raw
  modified_base (222)..(225): a, c, t, g, unknown or other
  misc_feature (222)..(225): n is a, c, g, or t
tcagagtcgagagacacgaccggtgctcgatttagtcgagctctctcgcgggctctcgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnn

SEQ ID NO: 168719 - DNA, 546 bp, Homo sapiens
  misc_feature: GYAE6OF02HZNTD.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattattaaccttttctcctggtaccaaacaacacccaggcaaagcccccaaaactcatcatttatgaggccgatcagcgccctgagggtctctgatcgtcttctctggcctccacgtctggcagccgacggcctcccgtgacaatctcgtggcctcgagcgtgggacgagcttgatttattattgctgttcattagtgccggttgagttagtcgggccggtaaagggtggttcgggacggaagggacgaaagggtcgaccggtaccgtaggtcgacggaccgaaggccgtcggaccccctggtacccg

SEQ ID NO: 168720 - DNA, 483 bp, Homo sapiens
  misc_feature: GYAE6OF02GZ9FA.49.82.H05.1.454.CMB.1.raw
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttcncctggtaccaacaacaccaggcaaacgcccccaaatcatcatttatgaggccgatcagccggccctcaggggtctctgatcgcttctctggctccacgtctggcagcacggcctcctgacatctctgggctcaggctgggacnggctgattattatnctgtcatntgcgtnatgngcgaggtgtggngaggacaaggtnacgtctagcagccgaagcncgccccgngtac

SEQ ID NO: 168721 - DNA, 601 bp, Homo sapiens
  misc_feature: GYAE6OF02G2MBB.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattattaacctttctcctggtaccaacaacaccaggacaaacgcccccaaatcatctatttatgagccatcacgcggccctcgaggggtctctgactccgtcttctcgtcggccttcccacgttcgtggaccgagccgaccggtccctcccgtagaacctaactcctcgtgggcctccgagggcgtacggggacgacggtctagtactttagttagttgtcgttcgttacagttagtcggtaccggtgtacgttaggttcgggacggtaaagggttcgttcgggacgggaagggaacgtaacgggtcgaccggttcgtaacggtcgacgacccgtaaggcctaccggtccccgtcggttacccg

SEQ ID NO: 168722 - DNA, 521 bp, Homo sapiens
  misc_feature: GYAE6OF02HZ7C6.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccaggcaaagcccccaaaactcatcatttatgaggccatcagcggccctcagggtctctgatcgcttctctggctccacgtctgcagcacggcctccctgacaatctctgggctcgaggctggggacgaggctgattattattgctgttcattatgccgtgagttagtggaccggaagggtgttcgggcgggagggaccgaaggtcgaccggtccgtaggcgagcccgaaggcctcgcccccgtggtacccg

SEQ ID NO: 168723 - DNA, 614 bp, Homo sapiens
  misc_feature: GYAE6OF02FZN3T.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcgagggtctctgatcgcttctctggctccacgtctggcagcgaccgcctccctgaccaatctctgggcctccgaggtcgtggggacgagggcttagatttattattgtcttgttactatagtcggtccggttagattagggtggacccggtaaggggtttcgggtttaccgggacggggacggggtaacccggtaagggttacggtaaccccggttacccggttaacgggttaccgaacggtcccccgaaacggggtcccgttacccgggtcccccccgttacgggttaccccg

SEQ ID NO: 168724 - DNA, 680 bp, Homo sapiens
  misc_feature: GYAE6OF02JMMT5.49.82.H05.1.454.CMB.1.raw
  modified_base (298)..(298): a, c, t, g, unknown or other
  misc_feature (298)..(298): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattattaacctttctctggtaccaacaacaccagacaacgccccaaactcatcatttangacgcgatcgacgccggccctaggacgggttctcgtgtactcgtcttctcgtcgtacctccctacggtcgtggaccacggaccgtacccggcccttcccgttacgaacctaacttcccgttcgtacggggtcccttaccgcggggtccgtaggggggaaccgtcgggttaccttagggttaacttttaacgttacggtttcgtacgttggttaactagttaacgtcgggttcgggtaagttacgtagggttccgggaaccggtaaggggttccgttacgggggacggaaggggtacggtaaacgggttcgaaccccgggttcgtaaagggtcccaacgggtccccaaagggttccccgtacccgtcccccggtaggtacccg

SEQ ID NO: 168725 - DNA, 591 bp, Homo sapiens
  misc_feature: GYAE6OF02HSN4Z.49.82.H05.1.454.CMB.1.raw
  modified_base (296)..(296): a, c, t, g, unknown or other
  misc_feature (296)..(296): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctgtaccaacaacaccagacaacgccccaaactcatcatttangacggccatcgacgccggccctcgagggtctctgactcgcttctctggcctccacgtctggcacgccaccggcctccctagacaactcgtcgtgggcctccgaggtcgtggggacgaggctagtattattattcgtcttgttctagtagtcgccggtagtagttagtcgggacggtaaggggttcggtacgggacgggaagggtaaccggtaaagggtccggtaaccggttccggtaacggtaccgaaccggacccgtaacgggtcccgtacccggtcccccgtcggttaccccg

SEQ ID NO: 168726 - DNA, 590 bp, Homo sapiens
  misc_feature: GYAE6OF02G0VDB.49.82.H05.1.454.CMB.1.raw
  modified_base (224)..(224): a, c, t, g, unknown or other
  misc_feature (224)..(224): n is a, c, g, or t
  modified_base (507)..(507): a, c, t, g, unknown or other
  misc_feature (507)..(507): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattataacctttctctgtaccaacaacaccaggcaaacgaccccaaactcatcatttatcgaggccgatcagccgccctcgacggggtcctcgtgactcgcttctctggcctccacgtcgtggcacgccgaccggccctcccgtgacctaactccgtcgttggggccttccgagtcggtacggggaacgacggtcttacgtattatttagtgtcttgttctatagtcgtcggtgtaagttggtcggcggtaaggggttgttaccgggngggtaacggaccggaagggtccgaccggtaccgtagggtccacggacccgaagggtccctccggtaccccggtccggttaccg

SEQ ID NO: 168727 - DNA, 630 bp, Homo sapiens
  misc_feature: GYAE6OF02HR5O9.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaaccacccaggacaaacgcccccaaaactcatctaatttatgaggccgatcagccggccctcgaggggtctctgactcgtccttctctcggctccacgtctggcagccacggcctcccgtagacaatctcgtgggcctccgaggcggtaggggacgaggcttagtatttattagttgcttcgttacaagttaagtcggtaccggttagtaagttagttcgggaccggtaaagggggttcgttccggggaccggggtacgggtaaccggtaagggttacggtaacccggtacccgttaacgggttccgaaccggtaccccggtaaacgggtcccgtttaccggccccccccggttagggttaccccg

SEQ ID NO: 168728 - DNA, 663 bp, Homo sapiens
  misc_feature: GYAE6OF02J1IVB.49.82.H05.1.454.CMB.1.raw
  modified_base (226)..(226): a, c, t, g, unknown or other
  misc_feature (226)..(226): n is a, c, g, or t
  modified_base (381)..(381): a, c, t, g, unknown or other
  misc_feature (381)..(381): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgccctccgtgtctgggtctccgtggacagtcgatcaccatctcctgcactgaaaccngcagtgatgttaggaattacgtaacctttctcctggtaccaacgaaccacccaggacaaacgcccccaaacttcactacattatagacggccatcacgcggccctcgacgggtcctctgtcaacgttccttctcgtcggcctaccgctgcgtacncgaccgaccggcccttccgtgaactacgtccttggcgggccctacggacgtcgggttacgggacgacggtcctagttattaatttcgtcacgtttgtacaagttcgtccgggtcggataacgttgccgggaaacggtgggttcgttaccggggacgggaggtaaaaccggttagggtacccggtaccgttaaccggggtaaccggttcggaaacccccggttaccccgggaaagggggtttcccctaacccccggttcccccccgggtttagggttaacccc

SEQ ID NO: 168729 - DNA, 168 bp, Homo sapiens
  misc_feature: GYAE6OF02HMO3Z.49.82.H05.1.454.CMB.1.raw
  modified_base (166)..(168): a, c, t, g, unknown or other
  misc_feature (166)..(168): n is a, c, g, or t
tcagagtcgagagacacgaccggtgctcgatttagtcgagctctctcgcgggcacgaccggtgctcgatttagtcacgcgagaaagggaaagggggctggccctgacgtgtttctgttcccaccctcctctctctcgactctgagcgggctggcaaggcgcatagnnn

SEQ ID NO: 168730 - DNA, 586 bp, Homo sapiens
  misc_feature: GYAE6OF02HJSOM.49.82.H05.1.454.CMB.1.raw
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (404)..(404): a, c, t, g, unknown or other
  misc_feature (404)..(404): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactgaaaccagcagtgatggttaggaattataaccttttctcctgtaccaacaacacccaggacaaacgacccccaaactcaatcatttangagcatcagccgccngagggtctctgatccgtcttcgtctcggtcctccacggtctcggcacgcgaccggcctccctgactaactcgtctcgggctccgnggcgtggggactagggcttgatttattacttgcttgttcagttgtacggccggttagtagttaggtcgggacggtaaggggttcgtccggggagggaacgggaacgtaaaggggtcgtacccggttacggtacggtaccgacggtacccgaagggtccctcccggtccccgtcggttacccg

SEQ ID NO: 168731 - DNA, 732 bp, Homo sapiens
  misc_feature: GYAE6OF02G4QA7.49.82.H05.1.454.CMB.1.raw
  modified_base (235)..(235): a, c, t, g, unknown or other
  misc_feature (235)..(235): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtggacagtcgatcacctatcctcctgcctactacgaaaaccngcagtagtattggttagggtaaatttaacttaaccttttctccgttacggtaaccaaaccaaccaacccgaaggaccaaaaccgacccccctaaactactaactacctaatttacgtaggacggaccgtatccgacggtcccgggtcccgtacggtacggggttcctacgtacgtactcgtccttctcggtcgtcctaccgtacgttcgtcggcgaccgccgtacccggtccctacccgtacgtaacctaactttccgtccggtccgggtcctaccggacgggtccgggtacggggaccggtacggtcgttagttatttatttacgttgttcgttgtactagttacgtcggtacggtgtaggtacgggttaggtaccgggtaaggggttcgggtacggggacgggtaacgggtaacggtaacgggtccggtaaccggttaccggttacggaccgaccggaccggtacggtcccggtaccggtccccgtacgtacccg

SEQ ID NO: 168732 - DNA, 672 bp, Homo sapiens
  misc_feature: GYAE6OF02HV16Q.49.82.H05.1.454.CMB.1.raw
  modified_base (303)..(303): a, c, t, g, unknown or other
  misc_feature (303)..(303): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggacaaacgcccccaaactcatcatttangaggccatcagccggccctcgagggtctcgtgactcgtcttctcgtgcctccacgtctggcagccgaccggcctcccgtagactaactccgtcgtcgggctccgagggtcgtaggggaccgaggcgttagtatttagttagttcgtctttagttactagttacgtcgggtacccggttaggtaacgttagggttacgggtaccgggttaaagggggtttcgggttacccgggggacggggtaacggggtaaaccggtaaaaggggttcccggtaacccgggttacccggttaacggggtacccgaaccgggtacccccggtaaacgggtccccgttaccccgggtcccccccggttacgggttaccccg

SEQ ID NO: 168733 - DNA, 648 bp, Homo sapiens
  misc_feature: GYAE6OF02JYXCT.49.82.H05.1.454.CMB.1.raw
  modified_base (381)..(381): a, c, t, g, unknown or other
  misc_feature (381)..(381): n is a, c, g, or t
tcagagtcgagagacacgaccggtgctcgatttagtcgagctctctcgcggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaaccaactaacacccagcaaagccccaaatcaatcatttatgaagccaatcgagccggcctcgagggtctacgtgtactcgtcttctcgtcggcctaccctacggtctcgggacaacggcccncccggtcctttcccgtaagtaacctaatccgtctcgggcctaccgaggtcgtggggaccgagctagtacttattacgtgtctaggttacagttagtcgtacggtgtaacgttaggtcggtacccgggtaaagggtttccgggttacgggacggggtaacgggtaacccgtaaggggttaccgttacccgggtaaccgttagggttacccggaacggtaccccggttaaacgggcccgttaaccggtcccccccggttaggttacccg

SEQ ID NO: 168734 - DNA, 644 bp, Homo sapiens
  misc_feature: GYAE6OF02ID35V.49.82.H05.1.454.CMB.1.raw
  modified_base (168)..(168): a, c, t, g, unknown or other
  misc_feature (168)..(168): n is a, c, g, or t
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (386)..(386): a, c, t, g, unknown or other
  misc_feature (386)..(386): n is a, c, g, or t
tcagagtcgagagacacgaccggtgctcgatttagtcgagctctctcgcgggggggtcgacgaagaggcagcgctctcgggacgtctccaccatggcctgggctctgctgctcctcactctcctcactcaggacacagggtcctgggcccagtctcgccctgactcancctgccctccgtgtctgggtctctggacngtcatcaccatctcctgcactcgaaaaccngccaggtnatggttaggaatttattaaccttttctcctaggtaccaaactaaccaccaggaccaaacgaccccaaaacctacactacctaatttactaggacggtccgactacgacgtcccggccctacgtacggggttcctcgtgacgtccgctttcnctcggtcctaccgtcgtacgtcggaccacgaccgacccggccttccccgtacgaactactcccgtcgttacgggcccttacggaacgggtcggtcgggggaacgtcggtcttaggtatttacttagttcgtcgtagttatacgtatcggcgtgtagttggcgggtacgtaggggttcgtcggaggggacggtacgtaagggccgtacgttaccggtgtcggtaccacccggtaggcctaccggtcccccgtaggtccg

SEQ ID NO: 168735 - DNA, 586 bp, Homo sapiens
  misc_feature: GYAE6OF02GQBW8.49.82.H05.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (414)..(414): a, c, t, g, unknown or other
  misc_feature (414)..(414): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttcnctgtacaacaacncccagacaaagccccaaatcatcatttangaggccatcagccggcctgagggtctctgatcgtcttctctggcctccacgtctggcagcgaccggccctccgtagacaatcctcgtcgggtcctccgaggcggtaggggacgacggngtagtatttattacgttgtcttagttctagttacgttcggaccggttgtagttagggttcggaccgggtaaggggtcggttacgggacgggagggaaccgtaagggtacggaccgtccggtaggtaccgacgccccggtaaggcccgtccggtcccccggtacggttacccg

SEQ ID NO: 168736 - DNA, 624 bp, Homo sapiens
  misc_feature: GYAE6OF02GLF7Z.49.82.H05.1.454.CMB.1.raw
  modified_base (438)..(438): a, c, t, g, unknown or other
  misc_feature (438)..(438): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtccctgggcccagtctgccctgactcagcctgcctccgtgtctgggtctcctggacagtcgatcaccatctcctgcactgaaaccagcagtgatgttgggaattataacctttctctggtaccaacaacacccaggacaaacgacccccaactcatctatttatgacggccgatcagccggccctcgacggggtctctgactccgtcttcctcgtcggcctcccacgttcgtgggcacgccgaccggtccctccctgaaccaattcctcgtgggccctcgagggcgtggggacgacggntgtattattagttgtccgttgttacctatacgttcggtcggtcgtaagttacgggtgggaccggtaaggggttgggttccgggacggggaacgggtaaggtaaacgggttaccggtacccggttaccgttagggtaacccgacggtaccccgaagggtcccgtcccgtcccccccggttacggtcc

SEQ ID NO: 168737 - DNA, 647 bp, Homo sapiens
  misc_feature: GYAE6OF02G261X.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattattaaccttttctcctggtaccaacaacacccaggcaaacgcccccaaactcactcatttatgaggccgatcacgcgccctcgagggtctctgatcgcttctctcggcctccacgttctggcacgccgacggtccctccctcgactaactcctcgtcgggcctccgaggcgtgggggacgagggtcttaggtatttagttattgtcttgttacagttacgtcggtccggtagtaacgttagggttcgggaacccggtaagggggtttccggttaccgggggacgggtaacgggggtaacggtaaaacggggttcgggtaaccccggtttaccggtaacgggttaccgaaccggtaccccggtaaacgggtcccgttacccgggtccccccgttacgggtaccccg

SEQ ID NO: 168738 - DNA, 189 bp, Homo sapiens
  misc_feature: GYAE6OF02HE73X.49.82.H05.1.454.CMB.1.raw
  modified_base (172)..(172): a, c, t, g, unknown or other
  misc_feature (172)..(172): n is a, c, g, or t
  modified_base (178)..(189): a, c, t, g, unknown or other
  misc_feature (178)..(189): n is a, c, g, or t
tcagagtcgagagacacgaccggtgctcgatttagtcgagctctctcgcggcacgaccggtgctcgatttagtcgagctctcccgcgagagagctcgactaaatcgagcaccggtcgtggtcactctgttcccaccctcctctctctcgactctgagcgggctggcaaggcncatagnnnnnnnnnnnn

SEQ ID NO: 168739 - DNA, 628 bp, Homo sapiens
  misc_feature: GYAE6OF02IW2K7.49.82.H05.1.454.CMB.1.raw
  modified_base (252)..(252): a, c, t, g, unknown or other
  misc_feature (252)..(252): n is a, c, g, or t
  modified_base (297)..(297): a, c, t, g, unknown or other
  misc_feature (297)..(297): n is a, c, g, or t
  modified_base (376)..(376): a, c, t, g, unknown or other
  misc_feature (376)..(376): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttcncctggtaccaacaacaccaggcaaagccccaaactcatcatttangagcgatcagcgcctcgagggtctcgtgatcgcttctcgtggccttccacgtctggcacgcacggcctccctgacatcnctgggctccgagcgtgggacgagtctgtacttattacgttgcttggttcagtacttgcccggttagacgttaaggttcgggaccggtaaagggggtttgtttaccggggacgggtaacgggggtaacccgtaaagggggttaccgtaacccggggtttacccgtaacggggtttacccgaaccgggttaccccggtaaaacggggttccccgttaacccgggtccccccccggtttagggtttaacccccgg

SEQ ID NO: 168740 - DNA, 580 bp, Homo sapiens
  misc_feature: GYAE6OF02IUMKM.49.82.H05.1.454.CMB.1.raw
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattattaacctttctcctgtaaccaacaacacccaggcaaacgacccccaaatcatcatttangacgccatcagccggccctcgagggtctcgtgactcgtcttctctggtctccacgtctggcagccaccggtcctccagacactctcgtggcctcgagcgtgggacngctagtattnttagtgctgttacattagtcgtcggtatacgttaggtcggaccggtaaggggttcgttacgggacgggtaacgggtaaccgtaacgggtcgtacccggttacgttaacgggaccgtaccggaccccgtaaagggtcccgtacccggtccccccgtggtacccc

SEQ ID NO: 168741 - DNA, 213 bp, Homo sapiens; identical to SEQ ID NO: 168652
  misc_feature: GYAE6OF02IFTO7.49.82.H05.1.454.CMB.1.raw
  modified_base (211)..(213): a, c, t, g, unknown or other
  misc_feature (211)..(213): n is a, c, g, or t

SEQ ID NO: 168742 - DNA, 604 bp, Homo sapiens
  misc_feature: GYAE6OF02JUJKY.49.82.H05.1.454.CMB.1.raw
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgtggaattataacttttctctggtaccaacaacacccaggacaaacgccccaaatcaatcatttatgacggccatcacgcgccctcgagggtctctgactcgcttctntcggtctccgacgtnggtcagcctacgcctcctanacactctgtcggctccgaggcgtagggaccgngccgtagtattagttagttgtcttagtttcaacgttgtcggtaccggtgtaacgtttaggtcgggtaaccggaaggggtttgtaccgggtacgggtaacggggtacccgtaaggggttccggtaacccggttacgttacggggacctacccggtaccggaacggttacccgtcccggtaccccccgtggttaacccg

SEQ ID NO: 168743 - DNA, 591 bp, Homo sapiens
  misc_feature: GYAE6OF02I1D1C.49.82.H05.1.454.CMB.1.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattataaccttttctcctggtaccaacaacaccaggcaaacgcccccaaatcatcatttangaggccatcagccggccctcgaggggtctctgactcgcttctcgtggcctccacgtctggcacgccaccggccctcccgtgaccaatccgtcgtcgggcctccgaggtcgtaggggaccgaggtcttagtactttattagttcgcttgttacaagttagttcgaccgggttgtagttaggtcgggtaccggtaaggggttggttccggacgggtacgggaccgtaaggggtcgacccggttccgtaaggtccacggacccgaaggccgtcccggtccccccgtggttaccc

SEQ ID NO: 168744 - DNA, 253 bp, Homo sapiens
  misc_feature: GYAE6OF02GGC07.49.82.H05.1.454.CMB.1.raw
  modified_base (247)..(253): a, c, t, g, unknown or other
  misc_feature (247)..(253): n is a, c, g, or t
tcagagtcgagagacacgaccggtgctcgatttagtcgagctctctcgcggcacgaccggtgctcgatttagtcgagctctctcgcgggcacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 168745 - DNA, 614 bp, Homo sapiens
  misc_feature: GYAE6OF02IBCGT.49.82.H05.1.454.CMB.1.raw
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctggacccagtctgccctgactcagcctgcctccgtgtctgggtctcctggacagtcgatcaccatctcctgcactgaaaccagcagtgatgttgggaattataaccttttctcctgtaccaacaacacccaggcaaacgcccccaaactcactcatttangagccgatcagcggccctcgagggtctcgtgatcgcttctctggctccacgtctggcagccacggcctcccgtagactaatcctacgtcgggctcgaggcgtaggggacgaggcttagtactttattagttgcttgttcattagtcgccggttgagttaggttcgggaccggtaaaggggttcgttacgggacggggtaacggggtaacgtaaagggtccggtaacccggttacccggttaacgggtacccgtaacgggaccccgtaaacggggtacccgttcccgggtaccccccccgttgggtacccccg

SEQ ID NO: 168746 - DNA, 640 bp, Homo sapiens
  misc_feature: GYAE6OF02IY1P6.49.82.H05.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccntcnctgcactgaaccngcagtnatgttggaattataaccttttctcctgtaaccaacaacacccaggacaaacgccccaaactcatcatttatgacgcgatcagccggccctcgagggtctcgtgacgtcgtcttctctcggcctccgacgttcgtcgggccacgccgaccggtcccctcccgtacgacctaacttccgtaccgttcgggtcctccgacgggtccgtacgggggaccggaggtccgttagtatttattagttcgtcttacgttcagttacgtcgtccggtagtacgtacgggttacgggaccggttaagggttcggttcgggcgggaaggggtaaccggtaaagggttaccggtaaccggttccggtaacggtacggtaaccgcccggtaaacggccggtacccggtcccccgttccggtacccg

SEQ ID NO: 168747 - DNA, 602 bp, Homo sapiens
  misc_feature: GYAE6OF02FWXLJ.49.82.H05.1.454.CMB.1.raw
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctggtaccaacaacaccaggcaaagcccccaaatcatcatttatgacggccgatcagccgccctcgagggtctctgatcgcttctctcggctccacgtctggcagccacggcctccngacaactctcgtggctcgaggtcgtggggacgnggtctagatttagttattcgtcgtttgttactagtagttcgtccgggttgtacgtaggtcgggtacccggtaaggggttcggttacggggacggggacgggaacggtaaacgggtccggtaacccggttcccgtaagggttccgaaccggtacccggtaaacgggtcccgttacccggtccccccgtacggttaccccg

SEQ ID NO: 168748 - DNA, 762 bp, Homo sapiens
  misc_feature: GYAE6OF02GUHYA.49.82.H05.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattataaccttttctcctgtaccaacacaccagcaaacgccccaatcatcatttangaggccatcagccggccctcgagggtctctgactcgtcttctctggcctccacgtcgtggcacgccaccggtccctcccgtagacctaagtcctacgtcgggtccctccgagggtccggtacgggggaccgtagggtccttaggtaacttttaagtttacgtttcggtaccgtttacgtttaccgtaagttacggtttccgggtacccggggtttagtaacgtttacgggggttaccgggtacccggggttaaaaggggggtttccgggttttacccggggggaccgggggtaaccggggggtaaaccccggttaaaaggggggtttacccggtaaaccccccggggtttacccggttaaccggggtttaccccgaaaccccggggttaacccccgggtaaacccggggttacccccggtttacccccggggtaccccccccccgggtttacgggttaacccccccg

SEQ ID NO: 168749 - DNA, 525 bp, Homo sapiens
  misc_feature: GYAE6OF02GPSER.49.82.H05.1.454.CMB.1.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctcctggtaccaacaacacccaggcaaagccccccaaactcatcatttangagccgatcagcggccctcagggtctctgatcgcttctctggctcacgtctgcagcacggccctccctgacaatctctgggctccagcgtgggacgaggctgattattattgcttgttcattagtcgccggtgagttagtggaccgtaagggtgttcgggcggaagggacaaagggtgacccgttcgaggtcacggacccaagggcctcgtcccccgtggtaccc

SEQ ID NO: 168750 - DNA, 532 bp, Homo sapiens
  misc_feature: GYAE6OF02FT5R9.49.82.H05.1.454.CMB.1.raw
  modified_base (393)..(393): a, c, t, g, unknown or other
  misc_feature (393)..(393): n is a, c, g, or t
  modified_base (443)..(443): a, c, t, g, unknown or other
  misc_feature (443)..(443): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcggccctcaggggtctctgatcgcttctctggctccacgtctggcagcacggccctccctgacaatctctgggctccaggcngaggacgaggctgattattactgcagctacatactaacaaacataaaccncgttgggtcgttcggcggacgggaacctaaacgtcggacccgtcctaacgtccacggccccaaaggcctccggccccccttgggtaccc

SEQ ID NO: 168751 - DNA, 624 bp, Homo sapiens
  misc_feature: GYAE6OF02H5JP1.49.82.H05.1.454.CMB.1.raw
  modified_base (468)..(468): a, c, t, g, unknown or other
  misc_feature (468)..(468): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgccactagaaaccagcagtgatggttaggaattacttaccttttctccgtggtaaccaaacaaccacccagaccaaacgaccccaaactcactctatttatgacggaccgatcacggccgccctcgacgggtctcgtgactcgtcttctcgtcggtcctcctacgtcgtcggacacgccgaccgtccctacccgtcgactaacttcgtcgtcgggcctcgacgggcgtaggggacgaggtctagtattagttatcgnacgtctactaataactaacaaactaattaaaccgtcggttaggtacggtaccgggaccgggacggtaaccctaaacgtcggtaaccccgttaccgtaaccgtaccgaccggacccgtacggcccgttaccccggtccccgttaccggtcctacccg

SEQ ID NO: 168752 - DNA, 580 bp, Homo sapiens
  misc_feature: GYAE6OF02F8U79.49.82.H05.1.454.CMB.1.raw
  modified_base (300)..(300): a, c, t, g, unknown or other
  misc_feature (300)..(300): n is a, c, g, or t
  modified_base (396)..(396): a, c, t, g, unknown or other
  misc_feature (396)..(396): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacacccaggcaaacgcccccaaactcatcatttangagccgatcagcgcctcgagggtctctgactcgcttctctggctccacgtctgcagcacggcctcctgacaatctcgtggctcgaggctggggacnggctagatttatattgcttgttcagttatcggtccggtagtagttaggtcgggaccggtaaggggttcggttacgggacgggtaaggggtaaccgtaaaggggttccggtaacccggttccgtaacgggttccgtaacggaccccgtaacgggcccttcccggtaccccccgttcggttacccg

SEQ ID NO: 168753 - DNA, 526 bp, Homo sapiens
  misc_feature: GYAE6OF02GBG8V.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagccccccaaaactcatcatttatgaggccgatcagcggccctcaggggtctctgatcgcttctctggctccacgtctggcagcacggcctccctgacaatctctgggctccaggcgtggggacgaggctgatttattattgctgttcatatgccgtgattagtcggccgaagggtgttcggcgggaggaccgaagggtcgacccgtcgtaggtcacggcccgaaggcctcggcccccgtggtaccc

SEQ ID NO: 168754 - DNA, 548 bp, Homo sapiens
  misc_feature: GYAE6OF02FM1QT.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcagccggccctcgaggggtctctgatcgcttctctggctccacgtctggcagcacggcctccctgacaatctcgtgggcctccgaggcgtggggacgaggctgatttattattgcttgttcatatggccggtgagttagtggaccggtaaggggttcgtacgggcgggacgggaccgaagggttcgacccggtccgtaggtccgacggcccgaaggcctccggcccccgtcggtccc

SEQ ID NO: 168755 - DNA, 541 bp, Homo sapiens
  misc_feature: GYAE6OF02FUI33.49.82.H05.1.454.CMB.1.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (374)..(374): a, c, t, g, unknown or other
  misc_feature (374)..(374): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaatttataaccttttctcctggtaccaacaacaccccaggcaaagccccccaaatcatcatttangagccgatcagcggccctcagggtctctgatcgcttcnctggctccacgtctggcagcacggccctccctnaccaatcctctcgggctccgaggctagggggacgaggctagattattattgcttgttctatagtgccggtgtataggtcggacgaagggttgttcgggcggacgggaccgaagggtcgacccgttccgtaggtcacggcccaagggcctccggccccctcggtaccc

SEQ ID NO: 168756 - DNA, 245 bp, Homo sapiens
  misc_feature: GYAE6OF02IS8J6.49.82.H05.1.454.CMB.1.raw
  modified_base (239)..(245): a, c, t, g, unknown or other
  misc_feature (239)..(245): n is a, c, g, or t
tcagagtcgagagacacgaccggtgctcgatttagtcgagctctctcgcgggacgaccggtgctcgatttagtcgagctctctcgcgggcacgaccggtgctcgatttagtcgagctctctcggcgggcacgaccggtgctcgattacgtcacgtcgagaaagggaaaggtgccctgacgtgtttctgttacccaccctcctctctctcgactctgagcgggctggcaaggcgcatagnnnnnnn

SEQ ID NO: 168757 - DNA, 600 bp, Homo sapiens
  misc_feature: GYAE6OF02HCV3L.49.82.H05.1.454.CMB.1.raw
  modified_base (299)..(299): a, c, t, g, unknown or other
  misc_feature (299)..(299): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagccccaaactcatcatttangagccatcagcgcctcgagggtctctgatcgcttctctcggctccacgttctggctacgcaccggccctccctgaacaatctcgtgggccttccgagggcgtacgggggacgaggtcttaggtaatttagttattcgtcttggtttacaagttagtcggccggttagagttaggtcgggaccggtaaggggttcgttccgggacgggtaacggggacccgtaagggttcggaacccggttaccgttacgggtaccacgggtaccccgaagggtccctaccggtccccccgtaggttacccg

SEQ ID NO: 168758 - DNA, 568 bp, Homo sapiens
  misc_feature: GYAE6OF02INATL.49.82.H05.1.454.CMB.1.raw
  modified_base (339)..(339): a, c, t, g, unknown or other
  misc_feature (339)..(339): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctaactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgagccgatcagcggccctcaggggtctctgatcgcttcncgtgcctcacgtctggcagcacggccctccctgacaatctactgggctcgaggcgtggggacgaggctgtattagttattgcttgttcattagtcgccgggttgacttaggcgggtaccgaaggggttcgttacggggcgggacggggaacgaaacgggtggtaacccggtccgttaaggtccgaacgtcccgaagggtcctccggtcccccgttcgggtacctacccg

SEQ ID NO: 168759 - DNA, 769 bp, Homo sapiens
  misc_feature: GYAE6OF02IEKM0.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactacgaaaccagacagtgagttggttagggtaaatttaacttaaaccctttttctacccgttacggtaacccaaaacaaccaaccccgaaggaaccaaacccgaccccccaaaactacaactacttaattttaacgtaggaacggtaccgtactacgacggtccggtccctcggtacggggttctcgtagactccgtcttctcgtcggtcctccgtacgtcgtcggacacggccgtacccggtcccttcccgtacgtaactaacgttccgttccggttccgggcccttaccgggtacgggtcgggttacgggggacgtaggtccgttaggttaactttagtttacgttcgtacgttaggttactaagttacgtacggtccgggttagtaagttcgggtacggggtaccgggtaagggggttaccgggttacggggacgggtaaccggggtaaccggtaaggggttacccggtacccggttaccgggtaaccggtccgaaccgggtacccggtaaaccggtcccgtaccccgggttcccccggtacggttaccccg

SEQ ID NO: 168760 - DNA, 657 bp, Homo sapiens
  misc_feature: GYAE6OF02IFABN.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactagaaaccagcagtgatgttgggaattataaccttttctctggtaccaacaacacccaggacaaacgcccccaaactcatctatttatgaggccatcagccgcctcgagggtctcgtgactcgtcttctcgtggcctccgacgtcgtggacacgccgaccggtccctcccgtagaacctaacttcctcgtcgggtcctccgtacgggcggtcgggggaacgaggtcttagtatttaagtttacttcgtcttacgttctaagttacgtcggtaccgggttagtacgttacggtcgggtaccgggtaaggggtttcgttaccggggacggggtaacggggtaaccgaaggggttacccgtacccgggttacccgttaacggtaccgtaaccggacccggtaaacggtccccggttacccggtccccccggttcggttaaccccg

SEQ ID NO: 168761 - DNA, 522 bp, Homo sapiens
  misc_feature: GYAE6OF02GMQ0W.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctctgtaccaacaacacccaggcaaagcccccaaactcatcatttatgaggccgatcagcgccctgagggtctctgatcgcttctctggctccacgtctggcagcacggcctcctgacatctcgtggcctcgaggcgtggggacaggctagatttattattgcttgttcattatcgcggtgagttagtggaccggtaagggttcgttcgggacgggaggacgaaggtcgaccggtctaggtcacggcccgaaggcctacgtcccccgtgtcc

SEQ ID NO: 168762 - DNA, 603 bp, Homo sapiens
  misc_feature: GYAE6OF02FY92H.49.82.H05.1.454.CMB.1.raw
  modified_base (223)..(223): a, c, t, g, unknown or other
  misc_feature (223)..(223): n is a, c, g, or t
  modified_base (345)..(345): a, c, t, g, unknown or other
  misc_feature (345)..(345): n is a, c, g, or t
  modified_base (380)..(380): a, c, t, g, unknown or other
  misc_feature (380)..(380): n is a, c, g, or t
tcagagtcgagagacacgaccggtgctcgatttagtcgagctctctcgcgggggggtcgacaagaggcagcgctctcgggacgtctccaccatgcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaatttataaccttttctctggtaccaactaacaccccaggcaaacgcccccaaactcatcatttatgacgccgatcagcggccctcgaggggtctctgatcgctttcnctggcctccgacgtctggccagccacggccctccngactaatcttcgtcggctccgaggcgtcggggacgaggctagtatttagttacttgtcttagttcgtaatagttcgtccgggtagttacgtagggtcggtccggaaggggttacggtttccgggacgggaacgggtaacccgaaagggttcggaaccccgttccggtaagggttcccgaacggttcccgaaacgggtctacccggtcccccgtccgggtaccg

SEQ ID NO: 168763 - DNA, 620 bp, Homo sapiens
  misc_feature: GYAE6OF02HNAH7.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactacgaaaccagcagtgattgttagggaattacttaaccttttctacctacggtaaccaacaacaccaggacaacgaccccaaactcaactctatttactggacggaccgacgtcgacgccggtccctcgacgggtctcgtgactcgcttctctcggccttccacgtctggctacgcgtaccggtcctcctagacaactcgtcgtcgggtctccgtaggcgtacggggacgtgtcgtagttattagtttacgttgtcttcgtttactagttacgtcggtacggtacgtagttacgggtcgggtacggtaagggttcggttacgggacgggaagggtaacgtaaacgggtcgtaccggtcggtaacggtacgacggaccgaggtccgtccgtccccgtacgtcccg

SEQ ID NO: 168764 - DNA, 511 bp, Homo sapiens
  misc_feature: GYAE6OF02G0QFC.49.82.H05.1.454.CMB.1.raw
  modified_base (453)..(453): a, c, t, g, unknown or other
  misc_feature (453)..(453): n is a, c, g, or t
  modified_base (497)..(497): a, c, t, g, unknown or other
  misc_feature (497)..(497): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggcaaacgcccccaaactcatcatttatgaggccgatcagccggccctcgagggtctctgatcgcttctctgctccacgtctgcagcacggcctcctgacatctctgggctcgaggcgtggggacgaggctgattattatgtctgttcatagtgccgtgatgtggccgaagggttcgtcggngggtaggacgaagggtcgaccggtcgtaggcagcccgtaggccncgtccccgtgtacc

SEQ ID NO: 168765 - DNA, 518 bp, Homo sapiens
  misc_feature: GYAE6OF02GFG2F.49.82.H05.1.454.CMB.1.raw
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatggttggaattataaccttttctctgtacaacaacaccaggcaaacgcccccaaancatcatttatgacgcgatcgacgcggccctcgagggtctctgatcgtcttctctcggcctccgacgtctggcagcaccggcctccngacaactctcgtcggctcgaggtcgtggggacnggtctgatttattatgctgttcatntgcgtanagtgnggcgagggtgtacgggnggaggacgaaggtcaccggtcgtaggtccgacgacccgagccgtcgccccgtgtaccg

SEQ ID NO: 168766 - DNA, 652 bp, Homo sapiens
  misc_feature: GYAE6OF02H54Q2.49.82.H05.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattataaccttttctcctggtaccaacaaccaccaggacaaacgcccccaaatcatcatttancgaggccgatcacgccggccctacgagggtctcgtgactccgctttctcgtcggtcctcccgacgtcgtgggaccacgtccgacccggtccttccctacgaactacttccgtacgttcgggcctccgaggtccggtaggggacgtaggccgttagtatttaagttagttgcttgttactaagttacgtcggaccgggttgtaacgttacgggtcgggtaccggtaaggggttcgggttaccggggacgggtaacgggtaccgtaaggggttccggtacccggtaccggttaaggttacccgacggtaccccgtaagggtcccgtacccggtccccccgttaggtaccccg

SEQ ID NO: 168767 - DNA, 724 bp, Homo sapiens
  misc_feature: GYAE6OF02GZ3U2.49.82.H05.1.454.CMB.1.raw
  modified_base (227)..(227): a, c, t, g, unknown or other
  misc_feature (227)..(227): n is a, c, g, or t
  modified_base (307)..(307): a, c, t, g, unknown or other
  misc_feature (307)..(307): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactagaaaccngcagtgatggttaggaattattaacctttctcctgtaaccaacaaccaccagacaaacgaccccaaactcatctatttangacggaccgatcacggccgccctcggacgggttctcgtgactcgtcttctcgtcggcctccgacgttcgtggccagccgaccggtccctacccgtagacctaacttcctcgtacgggtcctaccgagggccgggtacgggggaaccggacgggtccgttaggttaacgttttaagtttacgttcgttacgtttacggttactaagttacggttcgggtacccgggttagtaacggttacggggttcggggtaaccggggttaagggggtttccgggttacgggggaccggggtaacgggggtaaaccggtaaacgggggttaccggtaacccgggttaccggtaacgggttacccggaaccggtacccgggtaacgggtccccggttaccccgggtacccccggttaccggtacccg

SEQ ID NO: 168768 - DNA, 630 bp, Homo sapiens
  misc_feature: GYAE6OF02HDILM.49.82.H05.1.454.CMB.1.raw
  modified_base (310)..(310): a, c, t, g, unknown or other
  misc_feature (310)..(310): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactcgaaaccagcagtgatgttagggaattattaaccttttctcctaggtacctaacaacacccaggacaaacgcccccaaactcactactatttangacggccgatcacggccgccctcgacggggtcctcgtgacttccgtccttcgtcgtggccttcccgacgttcgtggacacggcgaccggtccctcccgtgaaccactctcgtcggtcctccgaggccggtaggggacgcgggcttgtatttattagttcgtcttgttacaagttagtccggtccggttagtagttacgggtcgggtaccggtaaggggtcggttcgggacgggtagggaacccgtaagggtccgtaccggttaccgtacgggtccaccggaccggtaaccggccgtacccgtacccccggttcgtacccg

SEQ ID NO: 168769 - DNA, 601 bp, Homo sapiens
  misc_feature: GYAE6OF02JWKK3.49.82.H05.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (331)..(331): a, c, t, g, unknown or other
  misc_feature (331)..(331): n is a, c, g, or t
tcagagtcgagagacacgaccggtgctcgatttagtcgagctctctcgcggggggtcgacaagaggcagcgctctcgggacgtctccaccatggcctggctctgctgctcctcactctcctcactcaggacacaggtcctgggcccagtctcgccctgactcagcctgcctccgtgtctgggtctcctggacagtcgatcaccatcctcctgcactgaaaccngcagtgatgtggaattataactttcnctgtaccaacaacaccagacaacgccccaaactcatcatttangacgcgatcagcgcctgagggtctctgactcgtacttcncgtggtacctccgacgtcgtacgcgtacgcgaccggtcctcccgtagactaactctacgtcgggctccgaggcgttcgggggacgaggcttagtactttagttacgttactcgtgtttaccagttacgtcgggtaccgttgtaacgttacgggtgggtaacccggtaagggttcgtacggggacggtaaggggaaccgtaaggggttaccgacggttccgtaacggtacgacggtccggaacggttccgtaccggtccccgtcgtacccg

SEQ ID NO: 168770 - DNA, 106 bp, Homo sapiens
  misc_feature: GYAE6OF02GHTBO.49.82.H05.1.454.CMB.1.raw
  modified_base (106)..(106): a, c, t, g, unknown or other
  misc_feature (106)..(106): n is a, c, g, or t
tcagagtcgagagacacgaccggtgctcgatttagtcgagctctctcgcgggcacgaccggtgctcgatttagtcgagctctctgcgggctggcaaggcgcatagn

SEQ ID NO: 168771 - DNA, 798 bp, Homo sapiens
  misc_feature: GYAE6OF02FFUBS.49.82.H05.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
  modified_base (344)..(344): a, c, t, g, unknown or other
  misc_feature (344)..(344): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacngtcgactcacctatcctctgacctactacgaaaccngcaggttcgagttggttacggaacttttactaaccttttccgccttacggtaaccaacctaaccaccctatacggaaccaaccgtacccccaaactcacttactaatttacgngacggccgtatccgacggccggtcccgtacggtacggggttctacgtacgcgttccgtccttcgtcgtcggtcccttacccgtacgtcgtcggacccgtacgacccgtacccgtcccttaccgacgtaacctacgttccgtacggtaccgggtaccctccgggacgggtacgggtacgggaacgggtacggttcgtagttttaacgttactttacgtttcgtccgtttacgtttaacgacgtttacgggtaccgggttacggttacggttaaggtaccgggttaccggggtacgggttaaacgggggtttcgggttacgggaacggggtaaccgggtaaaaccggtaacggggttaccccgggttaacccgttaccgggttaaacccggtccgtaaccccgggtaaccgggtaacccgtccccgggttaccccgtttaacccccggttccccgg

SEQ ID NO: 168772 - DNA, 790 bp, Homo sapiens
  misc_feature: GYAE6OF02JS9FB.49.82.H05.1.454.CMB.1.raw
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
tcagagtcgagagacacgaccggtgctcgatttagtcgagctctctcgcggggggtcgacaagaggcagcgctctcgggacgtctccaccatggcctgggctctgctgctcctcactctcctcactcaggacacagggtcctgggcccagtctcgccctgactcagcctgccctcgtcgtctgggtctcctggacagtcgatcaccatcncctgcctactcgaaaaccngaccagtgaacgttgttagggaattacttaaccgtttttccaccgttcggtaccaaacgtaaccaacccgaggtaccaaaaccgacccccctaaaactcgaataccaattttacgacgtaggcccggaaattcaaccggccggaccccttcgacggggttctactggacttcgcttcgtctcggcctttccgacgttcgtcgctaacggccacggtaccctcccgtagaaccaacgttccctcgtcgggtcccttaccgaacgggtccgtacgggggaccgacgggtcgttaacggttaactttacgtttaaggttcttactttacggtttactacgttaactttcggtacccgggttagttacgttaaacgggtcggggttaacccgtaaagggggttttcgggtaacccggggtcgggtaaccgggggtaacggttaaaccggggttacgggttaaccccgggttccgtttaaaccgggttaacgtaccgggtaaccccccggtaagggggtttacccctacccccggggttaccccccggttaccgggttacccccgg

SEQ ID NO: 168773 - DNA, 611 bp, Homo sapiens
  misc_feature: GYAE6OF02JPHUL.49.82.H05.1.454.CMB.1.raw
  modified_base (223)..(223): a, c, t, g, unknown or other
  misc_feature (223)..(223): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccatctcctgcactgaaaccngcagtgatgttggaattataaccttttcctggtaccaactacaccaggcaaagcccccaaactcatcatttatgaggccgatcagccgccctgacgggtctctgactcgcttctctcggctcccgagtctggctacgccgaccggtcccttcccgtgaacctaacgtcctcgtacgggcctccgagggccgttgggggacctagggtctagtatttagttattcgtcttcggttctaagttacgtcggtccggttagtacgttagttcgggaccggttaaaggggtgtttaccgggcgggtaagggaccgtaaaggggtccgtaaccggtccggtaacggtcgtaccggacccgtaaggtcccgtaccgtccccccgtggttaccccg

SEQ ID NO: 168774 - DNA, 510 bp, Homo sapiens
  misc_feature: GYAE6OF02HYU7O.49.82.H05.1.454.CMB.1.raw
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaaactcatcatttatgaggccgatcagcgccctcaggggtctctgatcgcttctctggctccacgtctggcagccacggcctccctgacaactctctggctccaggctggggacgagctgattattattgctnttcatntgcgtnagtgtggcgaagggtgttcggcgggagggacgaagggtcgaccggtcgtaggcacgcccgaaggctcgcccctggtccc

SEQ ID NO: 168775 - DNA, 512 bp, Homo sapiens
  misc_feature: GYAE6OF02G4CC1.49.82.H05.1.454.CMB.1.raw
  modified_base (401)..(401): a, c, t, g, unknown or other
  misc_feature (401)..(401): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctctggtaccaacaacacccagcaaacgcccccaaactcatcatttatgaggccgatcagcggccctcgagggtctctgatcgcttctctggctccacgtctgcagcacggcctcctgactaatctacgtgggctccgagcgtgggacgnggctgattattattgctgttacatatgtccgtgtagtgtcggcgtaagggtgttcgggcggaggacgaaggtacgacgtcgtgtcgacgccgaagctccgtcccctgtccc

SEQ ID NO: 168776 - DNA, 602 bp, Homo sapiens
  misc_feature: GYAE6OF02HX3FD.49.82.H05.1.454.CMB.1.raw
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (412)..(412): a, c, t, g, unknown or other
  misc_feature (412)..(412): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattattaaccttttctcctggtaccaacaacaccaggcaaacgcccccaaactcatcatttangaggccatcagccgccctcgagggtctctgatcgcttctctggctccacgtctggcacgcgaccgtccctcccgtnaccaatcgtcgtcggcctcgaggtcgtgggacgnggactagtatttattattgtcttgttacattagtcgtccggtagtacgtaggtcgggaccggtaaggggttcgtcgggacgggtaaggggaaccgaaaggggttccggtaacccgggttaccgtacgggtaccgtaacgggccccgtaaacgggtccccgtacccgggtccccccggttacggtaccccg

SEQ ID NO: 168777 - DNA, 546 bp, Homo sapiens
  misc_feature: GYAE6OF02FOBR1.49.82.H05.1.454.CMB.1.raw
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctctgtaccaacaacaccaggcaaacgcccccaaatcatcatttatgagccgatcagccggccctcgacggggtctctgatcgcttctctggctccgacgtctggcngcacggccctccngacatctcgtggcctcgaggcgtggggacgnggtctgattattattgcttgtcagtacgtggaccgttgaagttggtcggaccggtaaggggttcgttcgggcgggtaagggacgtaaagggtcgacccggttacgtacggtcgacgccgaggtcctccggtccccgtcggtccc

SEQ ID NO: 168778 - DNA, 166 bp, Homo sapiens; identical to SEQ ID NO: 168612
  misc_feature: GYAE6OF02G9XJ9.49.82.H05.1.454.CMB.1.raw
  modified_base (166)..(166): a, c, t, g, unknown or other
  misc_feature (166)..(166): n is a, c, g, or t

SEQ ID NO: 168779 - DNA, 252 bp, Homo sapiens
  misc_feature: GYAE6OF02FQRNV.49.82.H05.1.454.CMB.1.raw
  modified_base (249)..(252): a, c, t, g, unknown or other
  misc_feature (249)..(252): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnn

SEQ ID NO: 168780 - DNA, 641 bp, Homo sapiens
  misc_feature: GYAE6OF02F2B7J.49.82.H05.1.454.CMB.1.raw
  modified_base (301)..(301): a, c, t, g, unknown or other
  misc_feature (301)..(301): n is a, c, g, or t
  modified_base (366)..(366): a, c, t, g, unknown or other
  misc_feature (366)..(366): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttgggaattataaccttttctcctgtaccaacaacacccagacaaacgcccccaaactcatcatttangaggccgatcgacgccgtcctcgagggtctctgactcgtcttctgtcgcctccacgtcgtggacngaccgaccggtccctcccagactaactcgtcgtcgggcctccggaggtccgtaggggaccaggtctagtatttaacttagttcgtcgtttgttactaagttagtcggtaccgggtagtaaggttacggtcggggtaacccggtaaggggttcgggttaccgggacggggaacgggtaaacgtaaacggggttccgtaacccggttccgttaacgggtacgaacccggtaacccggaaacgggtcccctcccgggtaccccccgtgggttaccccg

SEQ ID NO: 168781 - DNA, 534 bp, Homo sapiens
  misc_feature: GYAE6OF02INSV1.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaaacaacacccaggcaaagcccccaaactcatcatttatgaggccgatcagcggccctgaggggtctctgatcgcttctctggctccacgtctggcagccacggccctccctgacaatctcgtggctccgaggcgtggggacgaggctgtattattattgctgttcatatgccgtgagtagtcggcgtaagggtcgttcgggcggacgggaccgaagggttcgaccggttccgtaggtcacggaccctaaggcctcggcccccctggtaccc

SEQ ID NO: 168782 - DNA, 107 bp, Homo sapiens; identical to SEQ ID NO: 168233
  misc_feature: GYAE6OF02G6N9U.49.82.H05.1.454.CMB.1.raw
  modified_base (107)..(107): a, c, t, g, unknown or other
  misc_feature (107)..(107): n is a, c, g, or t

SEQ ID NO: 168783 - DNA, 654 bp, Homo sapiens
  misc_feature: GYAE6OF02G40TY.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataactttctctggtaccaacacaccaggcaaacgccccaaactcatcatttatgacgccgatcgagcgcctcgacgggtctcgtgatcgtcttctcgtcggcctccgacgtcgtcggcacgccgaccggccctccgtgacctaactcgtcgtgggcctccgaggtccgtagggggaccgtagggcttaggtaagtttattaacgttcgtacttggttactaagttacgttacggtccgggtagtaacggttacggtacggggtaccggtaacgggggttcggtttaccggggcggggtaaggggtaaccggtaaaacggggtcccggtaaccgggttcccgtaacggggtccgtaaccggtaccccggtaaacgggtcccttacccgggtcccccggttaccggttaccccg

SEQ ID NO: 168784 - DNA, 204 bp, Homo sapiens
  misc_feature: GYAE6OF02JQQ4F.49.82.H05.1.454.CMB.1.raw
  modified_base (194)..(204): a, c, t, g, unknown or other
  misc_feature (194)..(204): n is a, c, g, or t
tcagagtcgagagacacgaccggtgctcgattagtcgagctctctcgcgggcacgaccggtgctcgatttagtcacgcgagaaagggaaagggggtgctcgatttagtcacgcgagaaagggaaggtggccctgacgtgtttctgttcccgccctcctctctctcgactctgagcggctggcaaggcgcatagnnnnnnnnnnn

SEQ ID NO: 168785 - DNA, 753 bp, Homo sapiens
  misc_feature: GYAE6OF02JOYYV.49.82.H05.1.454.CMB.1.raw
  modified_base (222)..(222): a, c, t, g, unknown or other
  misc_feature (222)..(222): n is a, c, g, or t
tcagagtcgagagacacgaccggtgctcgatttagtcgagctctctcgcggggggtcgacaagaggcagcgctctcgggacgtctccaccatggcctggctctgctgctcctcactctcctcactcaggacacagggtcctggcccagtctgccctgactcagccctgcctccgtgtctggtctcctgacagtcgatcaccatctcctgacactgaaacccngcagtgatgttcggaattataaccttttcctcgtagtacctaacaaccaccgtagaccaaacgtcccccaaaactccactacaatttacagacggccgataccacgtcggcccctagtacggggccttcacgtacgtccgtccgtttaccttccgttgggaaccctttcccgaacccggttttcccgttgggaccccgtaacggttccccgaaacccgggttccccctttcccgttagtacccctaaacggttaccctttccggtaccgggtccttaccccggcgggtaaccgtcgggggtaacccggacgggtcccgttagtaccgtttagttaacgtttcggtactttcgtacgtagttacttcggtcggtttaggacgtttacggtacggtaccggttaacgggttcgggttaccgggtacgggaacgggtccgtaaaacggggttccggtaacccggttaccggtacggtaacccggtacggtacccgtaggtaacccgtcccgggttacccctcccggggtaaccc

SEQ ID NO: 168786 - DNA, 176 bp, Homo sapiens
  misc_feature: GYAE6OF02GR7O2.49.82.H05.1.454.CMB.1.raw
  modified_base (173)..(176): a, c, t, g, unknown or other
  misc_feature (173)..(176): n is a, c, g, or t
tcagagtcgagagacacgaccggtgctcgatttagtcgagctctctcgcgggcacgaccggtgctcgatttagtcgagctctctacgcgggtcgagctctctcgcgggcacgaccggtgctcgaaaacaccctcctctctctcgactctgagcgggctggcaaggcgcatagnnnn

SEQ ID NO: 168787 - DNA, 636 bp, Homo sapiens
  misc_feature: GYAE6OF02F8Y2O.49.82.H05.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
tcagagtcgagagacacgaccggtgctcgatttagtcgagctctctcgcgggggggtcacaagaggcagccgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccaggcaaagcccccaaatcatcatttangacggccgatcagccggccctcgacggggtctcgtgactcgtcttctctggccttccgacgtctggcacgcaccggccctcctagacaactctcgtcgggctccgaggcgtcggggacgacggcttagtactttagttacgttgtcttgttacagttacgttggccggttagtaggttacggtacgggtaccggtaaaggggttcggttacggggaccgggtaaggggtaacccggtaacggggttccggtaaccccggttaccggttaagggtcccggtaaacggtacccccggtaaacgggtcccgttacccgggtccccccgttaccgggttaccccg

SEQ ID NO: 168788 - DNA, 634 bp, Homo sapiens
  misc_feature: GYAE6OF02HXNWO.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgacgttggtgattataactatgtctctggtaaccaacacgtaccaggcaaaacgccccaagactcatgtatttagtgcggtacaggtaacgccggtccctacggaccggggtcctagactccgtctttctcgtcggctaccgtaagtcgtcggaccaaccgccggtccctccctggacccgttcgttcgtcgggtccgtccgggctaggtaacgagtcggacggtcttaggttactttactttcgcggtactaccgtcttacgattacgtcgacgtacggaccaacggtaactaaacgtttaagttttgtaggtatttaacgggtcggggaacggtaacgggtaaccaacggtcgttaccgggtaacccgttaccgttaacgggtaccaccggtacccgtaacgg

SEQ ID NO: 168789 - DNA, 634 bp, Homo sapiens
  misc_feature: GYAE6OF02GIIMG.49.82.H05.1.454.CMB.1.raw
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctcgccctgactcagcctgcctcgtgtcgtgggtctcctggacagtcgatcacctatcctcctgcactagaaaccagcagtgacttgtaggaattattaacctttctctcgtaccaacaacaccagacaaacgcccccaaactcactctattagtgaggacgatcgacgccgtccgtacgtacgggtctctgactcgtcttcctcgtcgtacctccgtacgtcgcgtcacgcgaccgccctcctcgaacaactctcgtcggctacgcggtcggngggaccgnggacttgtactttagttacgttgtccgttgttactaacttcgttcggtaccgttgtaacgttagggtccgggacggttaaggggttcggttcggggtacgggtaacgggtaacggtaagggtccggttaacccggtacggttagggtacccgacggtaccggaccggtacccgtcccggttacccccgtcggttaccccg

SEQ ID NO: 168790 - DNA, 611 bp, Homo sapiens
  misc_feature: GYAE6OF02H1QN9.49.82.H05.1.454.CMB.1.raw
  modified_base (252)..(252): a, c, t, g, unknown or other
  misc_feature (252)..(252): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttntcctggtaccaacaacaccaggacaaacgccccaaactcactactatttatgacggccatcgacgccggccctcgacgggtctcgtgactccgtcttctctcggcctccgacgtctcgacacgccgaccggcctcccgtagactaactctcgtcgggcctcgacggcggtcggggacgtacggcgttagtatttagttcttagctagttcagtagtcggtccggtagtagttaggtcgggtacggtaacggggttcggtacgggacgggtaacgggtaccggtaagggtaccgtacccggttccgtacggtccgtaaccggcccggtaacggtcccgtaccgcccccgttggtaccccg

SEQ ID NO: 168791 - DNA, 579 bp, Homo sapiens
  misc_feature: GYAE6OF02HYMME.49.82.H05.1.454.CMB.1.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattattaacctttctcctggtaccaacaacacccaggcaaacgcccccaaactcatcatttangaggccatcagccggccctcgaggggtcctcgtgactcgcttctctcggctcccacgtcnggcagcacggtccctccctgacaatcctcgtcgggcctccgaggtccgtgggggacgaggtcctaggtatttaagttattgtctttgttcctaattgtcggtcccggtagtagttaggtcggggacgtaaggggttcggtcgggagggagggtaacgaagggtcgaccggtcgtacgggtccacgtcccgaaggtcctccgtcccccgtggtacccg

SEQ ID NO: 168792 - DNA, 637 bp, Homo sapiens
  misc_feature: GYAE6OF02F5KGA.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactgaaaccngcagtgatgtaggaattataacctttctcctggtaccaacaacacccagacaaacgcccccaaactcatcatttatgaggccgatcagcggccctcgaggggtctctgatcgcttctctcggcctccacgtctcggcacgcaccggccctcctgaacaatcctcgtgggcctccgaggcgtaggggacgaggctgtattattattgcttgttcatagtcggtccggtagacgttagggtcgggtacccggtaaggggtttcgttaccggggacgggaacgggggtaaccgtaaaaggggttccggtaacccgggtttacccggttaacggggttacccgaaccgggtacccccggtaaaacggggtccccggtttaccccgggtaccccccccggtttacgggttaacccccg

SEQ ID NO: 168793 - DNA, 214 bp, Homo sapiens
  misc_feature: GYAE6OF02IQI0Z.49.82.H05.1.454.CMB.1.raw
  modified_base (211)..(214): a, c, t, g, unknown or other
  misc_feature (211)..(214): n is a, c, g, or t
tcagagtcgagagacacgaccggtgctcgatttagtcgagctctctcgcgggcacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 168794 - DNA, 635 bp, Homo sapiens
  misc_feature: GYAE6OF02GBJ1Z.49.82.H05.1.454.CMB.1.raw
  modified_base (339)..(339): a, c, t, g, unknown or other
  misc_feature (339)..(339): n is a, c, g, or t
  modified_base (394)..(394): a, c, t, g, unknown or other
  misc_feature (394)..(394): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaatcatcattatgaggccgatcagcggccctcgagggtctctgatcgcttcnctggcctcacgtctggcagccacggcctccctgacctaatctcgtgggcctccgngggcgtgggggacgacgggtctgtactttagttagttgacacggcttcgaattaactaaaccaaaaactaacttaaaaaccgtacgtttaggggttccgggtttaccggggaccggggtacccggggtaaaccctaaaccggttcgggtaaccccggttacccgttaaaccggtccaaccgggcccccgtaaaggggtcccttacccggaccccccccggttacggttacccgtaaccccg

SEQ ID NO: 168795 - DNA, 195 bp, Homo sapiens
  misc_feature: GYAE6OF02JPQHG.49.82.H05.1.454.CMB.1.raw
  modified_base (186)..(195): a, c, t, g, unknown or other
  misc_feature (186)..(195): n is a, c, g, or t
tcagagtcgagagacacgaccggtgctcgatttagtcgagctctctcgcggcgacgaccggtgctcgatttagtcgagctctctcgcggcacgaccggtgctcgatttagtcgagctctctcgcgggcacgaccggtgctcgattttagtcgagctctctacgcgggctggacaaggcgcatagcnnnnnnnnnn

SEQ ID NO: 168796 - DNA, 592 bp, Homo sapiens
  misc_feature: GYAE6OF02F4462.49.82.H05.1.454.CMB.1.raw
  modified_base (301)..(301): a, c, t, g, unknown or other
  misc_feature (301)..(301): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacacccaggcaaacgcccccaaactcatcatttangaggccgatcagccggccctcgaggggtctctgatcgtcttctctggctccacgtctggcagcgaccggtcctccctgacctaatcctcgtgggtcctccgagggtccgtgggggaccgaggtcttagtaatttattagttgtccttgtttacattagtcgtccgggtagtagttaggtcgggtccggtaaggggttcggttaccgggcgggtaagggaacggtaaagggtcgtaacccggtccgtacggtcgacggcccgaaggtccctaccggtcccccgtggtacccg

SEQ ID NO: 168797 - DNA, 666 bp, Homo sapiens
  misc_feature: GYAE6OF02IF8NN.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactgaaaccagcagtgatgttaggaattataaccttttctctggtaccaacaaccaccaggacaaacgccccaaactcatctattatgacggccgatcacgcgccctcgacggggtctcgtgactcgtcttctcgtcgcctccacgtcgtcggcacgccgaccggtcctcccgtagaacctaacttcccgtacggtcgggtacccttcggaacgggtcggttacggggggaccggagggtccttagggttaactttagtttacgtttcgctttgttacagttagtcggccggttagtagttagtcggggtaccggtaaggggttcggttacggggacgggtaacggggtaccgtaaacggggttccggtacccgggttaccggttaacgggttacccgaacggtaccccggtaagggtccccttcccgggtccccccgttagggttacccccg

SEQ ID NO: 168798 - DNA, 519 bp, Homo sapiens
  misc_feature: GYAE6OF02HHL8D.49.82.H05.1.454.CMB.1.raw
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
  modified_base (464)..(464): a, c, t, g, unknown or other
  misc_feature (464)..(464): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggacaaacgccccaaactcatcatttatgacggccgatcagcgccctgagggtctctgatcgtcttctcgtggcctccgacgtctgcagcacggcctcctgacaatctctcgggctccgagggcgtggggacgaggctgattatattgctgttnatagtgcgtagagttcgnggaccgaagggtcgtcggnggaggacgaagggtcgaccgtcgtagtcacgaccgaagcgtccgccccgtgtccc

SEQ ID NO: 168799 - DNA, 549 bp, Homo sapiens
  misc_feature: GYAE6OF02HEQQY.49.82.H05.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattataacctttntcctggtaccaacaacacccaggacaacgccccaaactcactctatttatgacggccatcaggccggccctcgaggggtctcgtgtactcgtcttctcgtggtcctcccgacgtctgcagcgaccgtcctccgtgacactctcgtcggctcgnggcgtgggacgagcgtagtattattnttgtctntctatacgtgtcggtgtagtacgtcggacgtagggtcgtcgggacgggaggaccgaaggtcggtaccgtcgtacgtacgacgccgaacgcgtacccgtcccgtcggtaccg

SEQ ID NO: 168800 - DNA, 586 bp, Homo sapiens
  misc_feature: GYAE6OF02I1FI9.49.82.H05.1.454.CMB.1.raw
  modified_base (224)..(224): a, c, t, g, unknown or other
  misc_feature (224)..(224): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattataaccttttctcctggtaccaacaacacccaggcaaacgcccccaaactcatctatttatgaggccatcgagcggccctgacggggtctcgtgatcgtcttctctcggctccacgtctggcacgcaccggtccctcctgactactctgtcggcctccgnggcggtggggacgngctgtattattatcgtcttgtactatagtcgtacggtagtagtggtcgggacggtaagggttcggttaccgggagggtaacgggaacggtaacgggttaccggacccggttacggttacggtaccgaacggtacccgtaaggtcccgtaccggtccccccgtggtacccg

SEQ ID NO: 168801 - DNA, 651 bp, Homo sapiens
  misc_feature: GYAE6OF02H7G51.49.82.H05.1.454.CMB.1.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgntcacatctctgcactgaaaccngcagtgatggttggaattattaacctttctcctggtaccaacaacacccaggacaaacgccccaaaactcactcaatttatgacggccgatccgacgccggccctacggacgggttctcgtgtagtccgtcttcgtctcggtctaccacgttctcgggtcaacgccaccggacccttccccgtagaactaactccgttcggtcggtccgtcccgaacggtcggtcgggggacgacggtcgttagtaatttaacgttagttcgtcgtttagttctaatagttcggaccggttagtaaggttacggtacgggaccggtaaaggggttcgggttacgggacgggtaacggggtaccgtaagggtccggtaccggtccggttaaggtccgacggtacccgaaggtcccgtaccggtcccccggtagttccccg

SEQ ID NO: 168802 - DNA, 669 bp, Homo sapiens
  misc_feature: GYAE6OF02I4W1N.49.82.H05.1.454.CMB.1.raw
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgagtggttagggaattataaccttttctcctggtaccaacaacacccaggcaaacgcccccaaactcatcatttatgacggccatcacgccggccctcgacgggtctcgtgactcgtcttctcgtcggcctccacgttctcggcacgccgaccgtccctcccgtagaacctaactcctacgtcgggtcctaccgcgggcggtgggggacgaggtccgttaggtaagtttagttagttcgtacgtttgttactaagttacgtccggttaccggtaggtaacgttaggggttcgggtaaccgggtaagggggttccggttacggggaccggggtaagggtacccggtaaacggggttccggtaacccgggttccgttacgggtacccgtacggaccccggtaacgggtcccgtacccggtcccccccgtgggttaaccccg

SEQ ID NO: 168803 - DNA, 168 bp, Homo sapiens
  misc_feature: GYAE6OF02I2SB5.49.82.H05.1.454.CMB.1.raw
  modified_base (163)..(168): a, c, t, g, unknown or other
  misc_feature (163)..(168): n is a, c, g, or t
tcagagtcgagagacacgaccggtgctcgatttagtcgagctctctcgcggcacgaccggtgctcgatttagtcacgcgagaaagggaaggggctggccctgacgtgtttctgttcccaccctcctctctctcgactctgagcgggctggcaaggcgcatagnnnnnn

SEQ ID NO: 168804 - DNA, 691 bp, Homo sapiens
  misc_feature: GYAE6OF02IM1J2.49.82.H05.1.454.CMB.1.raw
  modified_base (230)..(230): a, c, t, g, unknown or other
  misc_feature (230)..(230): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (464)..(464): a, c, t, g, unknown or other
  misc_feature (464)..(464): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctcgggcccagtctgccctgacctcacgcctgcctccgtgtctgggtctcctggacagtcgatcaccatctcctgcactacgaaaccngacagtgagttggttagggaatttaattaacctttttctccgtacggttaaccaacaaacctacccgaggactaaaacgcccccaaaactacacgtactaattttaagngacggccgtaacnctacggccggtccctcggtacggggtctcgtgtactccggtcttctcttcggcctccacgttcgtcggcacgccgaccggtccctcctcgactactctcggtcgccgtccgnggtccggtacggggaccgacggggtacttacgggttaatttttacgtttacgttacgttcgtttacggtttcgacgtttacggtacggtccgggttaggttaacgttaggttacccggggtacgggttaaacggggttcggtacgggtacgggacggtaaccgtagggtaccgtcgtaccggttaggtcacggtaccgacggtaccgtccgtaccccggtctacccg

SEQ ID NO: 168805 - DNA, 632 bp, Homo sapiens
  misc_feature: GYAE6OF02HZV59.49.82.H05.1.454.CMB.1.raw
  modified_base (222)..(222): a, c, t, g, unknown or other
  misc_feature (222)..(222): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctctgcactgaaaccngcagtgatgtggaattataacctttctctaggtaccaacaacaccaggacaacgcccccaaactcactctatttatgacggcctatcacgccggtccctcgacggggtctcgtcgtactccgtcttctcgttcggaccttcccgtacgtccgtcggacacgccgaccggtcccttccctagaacctaacgtccttcgtcgggtcctaccggacgggtcggtacgggggacgagggcttaggttaacttagtttacgttgtcttcgttactagttacgtcggtccggtagtacgttacggtcgggaccggtagggttcggttacgggacgggacgggtaccgaagggttcggtacccgtcgtacggtcgacggtaccgaacgggtcctcccggtcccccgtaggtaccccg

SEQ ID NO: 168806 - DNA, 527 bp, Homo sapiens
  misc_feature: GYAE6OF02FKA8S.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccccaggcaaagccccccaaatcatcatttatgagccgatcagcggccctcaggggtctctgatcgcttctctggctccacgtctggcagcacggcctccctgacaatctctgggctccgaggcgtggggacgaggctgatttattattgctgttacattatgccgtgtatagtcggacggtagggtgttcggcggagggaccgaaggtgacccgtccgtacggtcgacggcccaaggcctcggccccctggtaccg

SEQ ID NO: 168807 - DNA, 718 bp, Homo sapiens
  misc_feature: GYAE6OF02GZLYB.49.82.H05.1.454.CMB.1.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattacttaacctttctctcgtaccaacaacaccagacaacgaccccaactcatactattangacgcatcgagccgccctcgacgggtctcgtcgacgttcgtcttctcgtcggtcctaccgtaccgtcgtaggacgacgtacccgtacccggtccccttcccgtacgaacctaaccgttccgttaccggtcgggtccctaccggtacgggtccgggttacggggggaaccgacgggtccgttaaggttaacgttttaagttttacgttcggttcctttaggtttacctaagtttacggttccgggtaccgggtttagtaacgttacgggtcgggtaccgggttaaggggttccggttaccgggggacgggtaaccgggtaaccggtaacgggttaccggtaacccgggttccggttaacggttcccgaaccgtaccggtaaccggtcccgtaccccggtcccccgttacggttaccccg

SEQ ID NO: 168808 - DNA, 666 bp, Homo sapiens
  misc_feature: GYAE6OF02JYKT5.49.82.H05.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtaggacagtcgatcaccatctcctgcactgaaaccngcagtnattggtagtaattacttactttctcgtacgtacaacaacaccacgacaaccgacccaacctacactactacttatagacgcgactcgacgccgacctcgtacgggtctcgtgtactcgtcttccgtcgtcgtcctcccgtaccgtcgtcggtacgacgaccgtaccggtccctacccgtacgtaaccgtactccgttaccggtccgggtaccgtaccggtaccggtacgggtacggggaccgtacgggtcgttagtaacgtttacgttacgttcgtacgttagttcgtagttacgtacggtacggtaggtacggttaggtcgggtacggtaaggggtcgtacgggtacgggtaacggtacggtaacgggtacgtacccggtacgtacggtacgaccggtaccggtacggtccgtacccggtcccgtaccgtaccg

SEQ ID NO: 168809 - DNA, 156 bp, Homo sapiens
  misc_feature: GYAE6OF02I1M34.49.82.H05.1.454.CMB.1.raw
  modified_base (151)..(156): a, c, t, g, unknown or other
  misc_feature (151)..(156): n is a, c, g, or t
tcagagtcgagagacacgaccggtgctcgatttagtcgagctctctcgcggcacgaccggtgctcgatttagtcgagctctctcgcgggcacgaccggtgctcgatttagtcgagctctctcgctctgagcgggctggcaaggcgcatagnnnnnn

SEQ ID NO: 168810 - DNA, 719 bp, Homo sapiens
  misc_feature: GYAE6OF02G1SJM.49.82.H05.1.454.CMB.1.raw
  modified_base (227)..(227): a, c, t, g, unknown or other
  misc_feature (227)..(227): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgccactcgaaaccngcagtgatggttaggaattataacctttctcctaggtaccaacgaacaccagacaaacgaccccaactcatacattatgacgcatcgagccgtcctacgacgggtctcgtagacgtcgtcttactcgtcggtcctaccgtacgtcgtacggactacggccgaaccggtcccgtacccgtacggtacctaaaccgttccgttccggtacgggtccctacccggtacgggtaccggtacgggggaaccgtacgggtaccgttaggttaattttaacgtttaccgtgttaccgttacgttacgtagttacgttcgggtaccggttaggtaacgttaacgggtaccgggtacggttaaacggggttccgggtaacgggtacggggtaacgggtaaccggtaaacgggtaaccggttaacccggttaccgtacgggttaaccaccgggtaacccgtaccgggtacccgtcccggtaccccggttacgttaaccccgg

SEQ ID NO: 168811 - DNA, 591 bp, Homo sapiens
  misc_feature: GYAE6OF02GHBP3.49.82.H05.1.454.CMB.1.raw
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
  modified_base (415)..(415): a, c, t, g, unknown or other
  misc_feature (415)..(415): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattatacctttctctgtaccaacaacaccaggacaaacgcccccaaatcatcatttangaggccatcagccgccctcgacgggtctcgtgactcgcttctcgtggcctcccacgtctggccagccgacggccctccctgaccaactcctcgtgggcctccgaggtccgtacggggacgngggcttaggattttattagttgtctttgttactaagttagttccggccggttgtaagttgggtcggtaccggtaagggtcgggttacgggacgggaagggtaaccgtaaagggtcggacccggttcgtaaggttccgacggacccgaaggtccgttcccggcccccgtcggtaccc

SEQ ID NO: 168812 - DNA, 664 bp, Homo sapiens
  misc_feature: GYAE6OF02ID4B1.49.82.H05.1.454.CMB.1.raw
  modified_base (409)..(409): a, c, t, g, unknown or other
  misc_feature (409)..(409): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagtcagtgatgttggaattattaaccttttctcctagtaccaacaacaccaggacaaacgccccaaaactcatcatttatagacgtaccgatacgacgaccggccctacgacggggttccttacgtgtactccgtcttctcgtcggcctccgtacgtcgtcggacacggccgaccgtccctcccngaactatccgtcgtcgggtacctcgtacgggcggtacggggacggacggtcttaggttattagtttacgttgccgtttaggttctaattacgtacggtccgggttagtacggtttacggtcgggaacggtaacggggtttaggttccggggacgggaacgggtaaccggtaaggtaccggtaccggttaccggtaacggtaccgaccggtaacccggaacggtcccggtacccgttcccccggtacggttacccg

SEQ ID NO: 168813 - DNA, 107 bp, Homo sapiens
  misc_feature: GYAE6OF02IQLLQ.49.82.H05.1.454.CMB.1.raw
  modified_base (106)..(107): a, c, t, g, unknown or other
  misc_feature (106)..(107): n is a, c, g, or t
tcagagtcgagagacacgaccggtgctcgatttagtcgagctctctcgcgggcacgaccggtgctcgatttagtcgagctctctgcgggctggcaaggcgcatagnn

SEQ ID NO: 168814 - DNA, 147 bp, Homo sapiens
  misc_feature: GYAE6OF02GM6BS.49.82.H05.1.454.CMB.1.raw
  modified_base (145)..(147): a, c, t, g, unknown or other
  misc_feature (145)..(147): n is a, c, g, or t
tcagagtcgagagacacgaccggtgctcgatttagtcgagctctctcgcgggcacgaccggtgctcgatttagtcgagctctctcgcgggcacgaccggtgctcgatttagtcgagctctcgagcgggctggcaaggcgcatagnnn

SEQ ID NO: 168815 - DNA, 578 bp, Homo sapiens
  misc_feature: GYAE6OF02GCS15.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccagcaaacgccccaaactcatcatttatgagccgatcagcgccctcgaggggtctcgtgatcgcttctctggctccacgtctggcagcacggccctcctgactaatctcgtcgggcctccgaggtcgtgggggacgaggtcgtagtactttattatgtcttgttacattacgtcggtccggtgtagttaggtcggaccgggtaaggggttgttccgggacggggtaagggaacgtaaagggtcggaacccggttccgtagggttaccgacggacccggtaacggccgttcccggaccccgttcggtacccg

SEQ ID NO: 168816 - DNA, 158 bp, Homo sapiens
  misc_feature: GYAE6OF02JD4K8.49.82.H05.1.454.CMB.1.raw
  modified_base (143)..(158): a, c, t, g, unknown or other
  misc_feature (143)..(158): n is a, c, g, or t
tcagagtcgagagacacgaccggtgctcgatttagtcgagctctctcgcgggcacgaccggtgctcgatttagtcgagctctctcgcggcacgaccggtgctcgatttagtcgagctctctcgcggctggcaaggcgcatagnnnnnnnnnnnnnnnn

SEQ ID NO: 168817 - DNA, 655 bp, Homo sapiens
  misc_feature: GYAE6OF02J1EYQ.49.82.H05.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactgaaaccngcagtgatgtaggattatacctttcnctgtaccaacacaccagacaaacgccccaaactcatcatttatacgacggaccatcacgccgccctcgagggtacctcgtgtactcgtccttctcgtcggtcctacccgtacgttcgtacgcgacgccgtaacccggccctacccgtagaacctatccgttcgtcgggccctccgtagggtccggtacgggacgtcgggtactacgtagttttaacttcgttagtcttcggtttctaaagttactccgggttaccgggttagaggtttaacgtcggggtaaccggtaaggggtttcggttccgggacgggacgggtaaaccggttacgggtaacgtacccggttaccgtaacgggccgtaaccggtacccaacgggttcctacccgggtcccccgtacggttaccg

SEQ ID NO: 168818 - DNA, 608 bp, Homo sapiens
  misc_feature: GYAE6OF02HDV63.49.82.H05.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (437)..(437): a, c, t, g, unknown or other
  misc_feature (437)..(437): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtnatggttaggaattataaccttttctcctggtaaccaacaacacccaggacaaacgcccccaaactcatcatttangaggccatcagcgccctcgagggtctcgtgactcgcttctctcggctccacgttctggcagccacggccctccctagacaactcctcgtcgggtcctcgcggtacgtgggggacgacggctcgatttaagttnttcgtcgttgtttacgattacgtacggtcccggttagaagttcggtcgggacggtaaagggtcggttacgggacggggaagggtaacgtaaaggggtcgaacccggttaccggtaacggttacgacccggaccgtaacgggcccgttacccggcccccgttacggtacccg

SEQ ID NO: 168819 - DNA, 675 bp, Homo sapiens
  misc_feature: GYAE6OF02J0B3N.49.82.H05.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctcgccctgactcagcctgcctccgtgtctgggtctcctggacagtcgatcaccntctcctgcactgaaaccngcagtgatgttaggaattataacctttctctacgtacaacaacaccagcaaacgccccaactcatcattatagagccgtactcacgccggtcctcgacgggtctcgtgtactcgtctctcgtggtcctccgtacgtctggtccacggtaccgaccggtccctcccgtacgtaacctacgttccgtccgtgggtccctaccggtacgggtacggttacgggggaccgtacgggtacgtttacggtaatttaacgtttacgttcggttactttcggttacttacgttagttccggtacccgggttagtaacgtttacgggttacgggtaccggtaacgggggttcgttaccggggtacgggtaacgggtaccggtaacgggttaccgtaccggtccggtacggtacgtaccggaccggtaacggccgttcccggaccccggtccggttacccg

SEQ ID NO: 168820 - DNA, 762 bp, Homo sapiens
  misc_feature: GYAE6OF02G5UFF.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatcctcctgccactgaaaccagcagtgagtggttaggaattattaaccttttctcctaggtaccaacaacaccaggacaaacgacccccaaactcatctatttatgacggaccgatcgagccggccctcgacggggttctacgtgtactccgtcgttcctcgtcggccttccgaccgttcgtcggaccgacgaccgacccgggtccccttaccccgtacggaacctaaacgttcccgtttacggtaccggggtcccttacccggacggggtccggtaacggggggtaacccggaacgggtccgttaggttaaacgttttaacgttttaaggttcgttcggtttacggtttacgtaacgtttacggttccggtaccggggttataacgggtttcgggtacgggggtaacccggtaaggggggtttcgttaccgggggacggggtaacggggtaaaccggtaaacggggttacccggttaaacccgggtacccgttacgggtacccgaaccgggacccgtaacgggtcccgtcccggtacccccgttccggttacccg

SEQ ID NO: 168821 - DNA, 652 bp, Homo sapiens
  misc_feature: GYAE6OF02J02AX.49.82.H05.1.454.CMB.1.raw
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactcgaaaccngcagtgatggtggaattatactttctctggtaccaacacaccagacaacgccccaancatcattangagccgatcacgccgccctgtacgggtctcgtgactcgcttcgctcggtcctccgtacgtcgtcggaccacgccgtacccggtcctacccgtgaactacgtccgtccgttcgggcccttaccgtacgggtccggtacggggggtaacccgagggttcccgttaggttaacgtttatttacgttcgggtcctttacggtttactaagtacttccgggtaccggtagtaacgttaagggtaccgggtcgggttaacggggttaggttcccggggacgggttaacgggacggtaacggtccggttacccggtaccggttagtccgacggccgaacggtccgtcccggacccccgttggtcccc

SEQ ID NO: 168822 - DNA, 682 bp, Homo sapiens
  misc_feature: GYAE6OF02JCYZV.49.82.H05.1.454.CMB.1.raw
  modified_base (225)..(225): a, c, t, g, unknown or other
  misc_feature (225)..(225): n is a, c, g, or t
  modified_base (312)..(312): a, c, t, g, unknown or other
  misc_feature (312)..(312): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctcgggcccagtctgccctgactcagcctgcctccgtgtctgggtcctcctggacagtcgatcaccatctcctgcactgaaaccngcagtgatggttaggaattacttaccttttctcctacgtaaccaacaaccaccgacgacaaaccgaccccaactcactactatttanacgacggccatccgacgccgccctacgacggtactcgtacgtagtacgtcgtcctttcgtcgtcgtccctccgtacgttcgtacgactacgccgtaccggcccttcccgtacgtaacctacttccgtaccggtcggtacccgtccgacgggtcggtacgggaccggtagggtacgttacgtaacgtttagttacgtttcgtacgtttcgtactacgttacgtcggtcggtagttacgttacgggtacggtaaccgggttaacggggttcgtacggggaaccgggtacgggtaaaccggtaagggtaccggtaccggttaccgtagggtaccgacggtacccggaacggtccgttacccgccccggtacgg

SEQ ID NO: 168823 - DNA, 555 bp, Homo sapiens
  misc_feature: GYAE6OF02GYYKM.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctggtaccaacaacacccaggacaaacgcccccaaactcatctattatgaggcgatcagcgccctcgagggtctcgtgactcgtcttctctcggctccacgtcgtgcacgcaccgtcctcctgactaatcctcgtgggcctccgaggcgtggggacgaggctgtatttattagttcgtactgttactattacgtggtccggtgtagttgtcggacggtaagggttcgttcgggcggtaagggaccgaagggtcgtaccgtccgtaggtcgacgcccgaaggcctccggtccccgtcggtaccc

SEQ ID NO: 168824 - DNA, 581 bp, Homo sapiens
  misc_feature: GYAE6OF02I2HLB.49.82.H05.1.454.CMB.1.raw
  modified_base (225)..(225): a, c, t, g, unknown or other
  misc_feature (225)..(225): n is a, c, g, or t
  modified_base (373)..(373): a, c, t, g, unknown or other
  misc_feature (373)..(373): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactcgaaaccngcagtgagttggtaggaacttattaacctttctcctaggtaaccaacaacaccaggacaaacgaccccaaactcatctatttacaggacggccgtatcacgccggaccctcgtacgggtctctgactcgtctctcgtcgctcacgtcngcacgcgacgcctcctagacactctcgcgggtcctcgacgggcgtaggggaccgtaggtcgtagtattagttagtctacgttcgttactattacgtcgtaccgggttagtacgtagggttcggacggtagggtcggtacgggcggtaggaccgtaaggtcggtaccgtcggtaggtccgacggaccgaagtcctccggccctcggtcc

SEQ ID NO: 168825 - DNA, 715 bp, Homo sapiens
  misc_feature: GYAE6OF02JQGDS.49.82.H05.1.454.CMB.1.raw
  modified_base (227)..(227): a, c, t, g, unknown or other
  misc_feature (227)..(227): n is a, c, g, or t
  modified_base (330)..(330): a, c, t, g, unknown or other
  misc_feature (330)..(330): n is a, c, g, or t
tcagagtcgagagacacgaccggtgctcgatttagtcgagctctctcgcgggggggtcgacgaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccatcctcctgcctactgaaaccngccagtgacttggttgggaattacttaaccttttctccttacggttaaccaacaaccacccaaggaccaaacgacccccaaacttccaactacctaatttaangtacggccgatccaagccggaccctcgaggggtcctcgtgactcggtccttctcgtcggccttacccgacgttcgtcggtcgtaacgcgaaccggtcctcccgtcggaacctaacgtcctcgtaccgggccttacccggacgggtccggttagggggaaccgacgggtcccttagtacgtttagttaacgtggtcctttgttactagtacgttcggtccgggttaacgtgtttaacggccgggtaaccgggtaacgggtttcgggttaccgggcggggtaacgggtaccggtaaggggttacggtaaccccggttccggttaacggtacggtaccggacccggtaaggtcccggtacccggtacccccggttacggttaacccgg

SEQ ID NO: 168826 - DNA, 555 bp, Homo sapiens
  misc_feature: GYAE6OF02G62K9.49.82.H05.1.454.CMB.1.raw
  modified_base (256)..(256): a, c, t, g, unknown or other
  misc_feature (256)..(256): n is a, c, g, or t
tcagagtcgagagacacgaccggtgctcgatttagtcgagctctctcgcgggggggtcaacgaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactgaaaccagccagtgatgttgggaacttataaccttttcncctggtaccaacaacacccaggcaaacgcccccaaactcatcatttatgaggccatcagcggccctgagggtctctgatcgcttctctggcctccgacgtctggcagccacggccctccctgacaatctctgggctccgaggctggggacgaggctgatttattattgtacttggttacattatcgccggttgagttacgtgggaccgtaagggtcgttcgggcggaacgggtaacgaagggtcgtaccggtccgtaaggtcgacggcccgaaggtcctaccggtcccccgtgtacccg

SEQ ID NO: 168827 - DNA, 217 bp, Homo sapiens
  misc_feature: GYAE6OF02FWB4U.49.82.H05.1.454.CMB.1.raw
  modified_base (213)..(217): a, c, t, g, unknown or other
  misc_feature (213)..(217): n is a, c, g, or t
tcagagtcgagagacacgaccggtgctcgatttagtcgagctctctcgcgggcacgaccggtgctcgatttagagagagtgtggttgggtttggggggaagaggaagactgacggtcccccaggagttcaggtgctgggcacagcggccctgggctgcctggtcaaggactacttcctctctcgactctgagcgggctggcaaggcgcatagnnnnn

SEQ ID NO: 168828 - DNA, 619 bp, Homo sapiens
  misc_feature: GYAE6OF02IDKWZ.49.82.H05.1.454.CMB.1.raw
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (433)..(433): a, c, t, g, unknown or other
  misc_feature (433)..(433): n is a, c, g, or t
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaaccngcagtgatgtacggaattatacctttcnctgtacaacaacaccaggacaaacgccccaaatcatcattatgagtccgatcgacgccgcccgtgacgggtctcgtagactccgtcttcgtcgtgtccttcccgtacgtctcgggacacgccgtaccggccctacccgagtaaccattctcgtcggcttccgagggtcgtacggggaacncggtctaggttaacttattacgtgtactgttanacgttacgnggtcccggtaatacgttaagggcgggtaacggtaacggggtggtttaccggcggggtaagggtaaaccggtaaggtaccgaccggttaccgtacgggtacgaccgtaccgtaacgggccctccggtacccccggttgtaacccg

SEQ ID NO: 168829 - DNA, 601 bp, Homo sapiens
  misc_feature: GYAE6OF02F9BFD.49.82.H05.1.454.CMB.1.raw
  modified_base (296)..(296): a, c, t, g, unknown or other
  misc_feature (296)..(296): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattatacctttctcctgtaccaacacaccagcaaacgcccccaaactcatacatttangacggccgatcacgccggccctcgaggggttctcgtgactcgtacttcgtctcggtctcccacgtctggcngccgacgccctcctcgactatctcgtcggacctcgaggcggtggggacgnggcgtgatttattnttcgtcttgttctagtatcgggtaccgtagagttaggtacggtaccggtaggggttcgttacgggggacggtaacgggaacggttaacgggtccgtaaccgggttccgtaacgggtacgaaccgggacccgttaaggtcccgtacccggtacccccgtcgggttaccccg

SEQ ID NO: 168830 - DNA, 714 bp, Homo sapiens
  misc_feature: GYAE6OF02GBA9K.49.82.H05.1.454.CMB.1.raw
  modified_base (222)..(222): a, c, t, g, unknown or other
  misc_feature (222)..(222): n is a, c, g, or t
  modified_base (296)..(296): a, c, t, g, unknown or other
  misc_feature (296)..(296): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactgaaaccngcagtgatgttggaattataacctttctcctggtaccaactaacaccaggccaaagccccaaactcatcattangtagccatcagtccggcctcgacgggtctcgtgacttccggctttctccgtggtctcccacggttctacgggtccagtaccgacccgggtccctcccgttacgaccgtaaacttcccgttcgtaccgggtccttacccggtacgggtaccgggttacggggggaacccggtacgggtaccgttacggtaacgttttaagttttaacgttccgggtacgtttcggtttaccgttaacgttaagttccgggtaacccggttgttaacgttacgggtccgggtaaccggtaacggggttacggttcggggcgggtaaagggaacggttaaacgggtacggtacccgggttaccgtaacgggttacgaccggaacccggtaacggtcccggtacccggttaccccccgtgggttaacccccg

SEQ ID NO: 168831 - DNA, 582 bp, Homo sapiens
  misc_feature: GYAE6OF02FW1GU.49.82.H05.1.454.CMB.1.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
  modified_base (393)..(393): a, c, t, g, unknown or other
  misc_feature (393)..(393): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccagcaaagccccaaatcatcatttangagccgatcagcggcctcgagggtctctgactcgcttctctcggtctcctacgtctggcagccacggccctccctgaccaatctcgtggctccaggtcgnggggacgaggctagtatttattattgtctgttactatagtcgtccggtgtacgttaggtcggtaccggtaaggggttcgttcgggcgggacgggaccggtaagggtaccggtacccggttcccggtaacgggttaccgaccggaccccgtaaacgggtcccgtaccggtccccccgttcgggtaccccg

SEQ ID NO: 168832 - DNA, 623 bp, Homo sapiens
  misc_feature: GYAE6OF02F17N7.49.82.H05.1.454.CMB.1.raw
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctctggtaccaacaacacccaggcaaagcccccaaactcatcatttatagaggccgatcagcggccctcaggggtctctgatcgcttctctgctccacgtctggcagcacggcctcccgtgacaactctcgtgggccttccgngggtccgtgggggaaccgngggcttgatttattacgttgcttggttaccagttagtcggtaccgggttgtaacgttaaggtcgggacccggttaaagggggttcgttacggggacgggtaaggggtaaccgaaaaggggttcggtaacccggttcccggtaacgggttccgaacggacccccggtaaagggttcccgtacccgggttaccccccctcggggtttaacccc

SEQ ID NO: 168833 - DNA, 529 bp, Homo sapiens
  misc_feature: GYAE6OF02IR7XX.49.82.H05.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactagaaaccngcagtgatggtggaattataaccttttctcctggtaccaacaacacccaggcaaacgcccccaaactcatacatttangagccatcagcgtcccngagggtctctnacgtcgtctctctcggcctccgacgtctcggcacgcaccggtccctcctgaaccactcctagtcggctccgaggtcgnggggacgngcttagtattattagtcgtntgtnatcgtgcgtntatggtcggacggtaggtcggtcggacggaggacgaaggtcgaaccgtcgtagcacggccaggctaccgcccgtgtacc

SEQ ID NO: 168834 - DNA, 590 bp, Homo sapiens
  misc_feature: GYAE6OF02J19YI.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataactttctcctgtacaacaacaccagcaagccccaactcatctattatgacggccatcacgcggccctcgacggggtctctgactccgtcttctctcgtctcctacgtctggcacgcgaccgtcctcctgacctatctctcgggcctcgacggtcggtggggaccgaggtctagtactttagttacgttcgtacgttcgttactacgtagttcggtccggtaggtagttacgggttcgggaccggtaggggttcggtacgggcgggacgggtaccggtaagggtccggtaccggtaccgttacggaccgacggtcccgaggtccgtcccggtccccgtcggtacccg

SEQ ID NO: 168835 - DNA, 644 bp, Homo sapiens
  misc_feature: GYAE6OF02FUK8B.49.82.H05.1.454.CMB.1.raw
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacacccaggacaaacgcccccaaatcatctatttangagccgatcagccggccctcgaggggtctctgatcgtcttctcgtggcctccacgtctcggcagcgaccggccctccctgacctaatcctcgtcgggctcccgggngtcgggggacgaggctgtatttattagttgtcttgttacattacgtcggtccgggtgtacgttacgggtcgggtaccggtaaaggggttcgtttccgggggacggggtaacggggtaaccgtaaaggggttccggtaacccgggtttacccgtaaggggttcccgtaacgggtaccccgtaaacggggtcccgttaccccgggtcccccccggttacgggttacccttaaccccgg

SEQ ID NO: 168836 - DNA, 166 bp, Homo sapiens; identical to SEQ ID NO: 168245
  misc_feature: GYAE6OF02F9286.49.82.H05.1.454.CMB.1.raw
  modified_base (165)..(166): a, c, t, g, unknown or other
  misc_feature (165)..(166): n is a, c, g, or t

SEQ ID NO: 168837 - DNA, 691 bp, Homo sapiens
  misc_feature: GYAE6OF02GUEAT.49.82.H05.1.454.CMB.1.raw
  modified_base (224)..(224): a, c, t, g, unknown or other
  misc_feature (224)..(224): n is a, c, g, or t
  modified_base (306)..(306): a, c, t, g, unknown or other
  misc_feature (306)..(306): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactagaaaccngcagtgatggttaggaattacttaaccttttctcgtggtaccaacaaccaccaggacaaacgccccaaactcatctatttangacggccgatcgacggccgtccctcggtacgggtcctcgtgacttcgtcttctcgtcggtcctaccgtacgttcgtcggtaccgacggtcccgacccggtcccttaccgtacgacctaacttccgtcggtcgggtcctcggacgggtcggtacggggacgcggtagttagttatttacgttagttcgtcgttagttactagttcgtcgggtcggttagtacggttacgggtcgggtacggtaaggggttcgggtacggggtacggggaacggtaacggtaacggggtaccggttaccggttaccggtaaccgggttaccgaacccgggtaacccggtaacgggttaccccggtaccccggttacccccggttacggttaaccccg

SEQ ID NO: 168838 - DNA, 108 bp, Homo sapiens; identical to SEQ ID NO: 168633
  misc_feature: GYAE6OF02FJIZI.49.82.H05.1.454.CMB.1.raw
  modified_base (107)..(108): a, c, t, g, unknown or other
  misc_feature (107)..(108): n is a, c, g, or t

SEQ ID NO: 168839 - DNA, 212 bp, Homo sapiens; identical to SEQ ID NO: 168241
  misc_feature: GYAE6OF02I4ZVQ.49.82.H05.1.454.CMB.1.raw
  modified_base (211)..(212): a, c, t, g, unknown or other
  misc_feature (211)..(212): n is a, c, g, or t

SEQ ID NO: 168840 - DNA, 650 bp, Homo sapiens
  misc_feature: GYAE6OF02FKU6K.49.82.H05.1.454.CMB.1.raw
  modified_base (298)..(298): a, c, t, g, unknown or other
  misc_feature (298)..(298): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctctggtaccaacaacaccaggcaaagcccccaaactcatcattangaggccatcagcgccctcgagggtctctgtactcgcttctcgtggcctccacgtctcggactacgccaccggtcccttccccgtagtaacctaactcctcggtcgggtccttccgacggccggttacggggggaacgtaacggggtcttaggtaattttaagtttattcggtcttcgggtttaccaagttaacgttcgggtacccggttagtacgttaggtcgggtaccggttaaagggggttcggtttaccggggcgggtaacgggtacccggtaaagggtaccggtacccggttaccgtaacggtccgtacgacccggtacggtccgtccggtccccccgtaggtacccg

SEQ ID NO: 168841 - DNA, 213 bp, Homo sapiens
  misc_feature: GYAE6OF02FJMBR.49.82.H05.1.454.CMB.1.raw
  modified_base (211)..(213): a, c, t, g, unknown or other
  misc_feature (211)..(213): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgtgcacagcggccctgggctgcctggtcaaggactacttcctctctcgactctgagcgggctggcaaggcgcatagnnn

SEQ ID NO: 168842 - DNA, 312 bp, Homo sapiens
  misc_feature: GYAE6OF02F668K.49.82.H05.1.454.CMB.1.raw
  modified_base (301)..(301): a, c, t, g, unknown or other
  misc_feature (301)..(301): n is a, c, g, or t
  modified_base (307)..(312): a, c, t, g, unknown or other
  misc_feature (307)..(312): n is a, c, g, or t
tcagagtcgagagacacgaccggtgctcgatttagtcgagctctctcgcgggcacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcncatagnnnnnn

SEQ ID NO: 168843 - DNA, 607 bp, Homo sapiens
  misc_feature: GYAE6OF02JXW0S.49.82.H05.1.454.CMB.1.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (326)..(326): a, c, t, g, unknown or other
  misc_feature (326)..(326): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtnatgtggattatacctttcnctgacacacaccagacaanccccaaatcatcattangagccatcacgccggccctgagggtcctctgactcgtcttntccgtgtcctccgtacgtcgtcggcctaaggccgtacccggtccttcccgtacggaacctaacgtcccttcgggtccgggaccctttccggaacgggtccggttacgggggaccgtagggtccttaggtaactttaactttgtcgtacctttggttaaccagtacgttcggcgttagacgttaggttcggacggtagggttcgtacgggaggacgggtacaaggggtctaacccggtcgtaggtccacggtaccgacggtcctaccgggccccgtggtacc

SEQ ID NO: 168844 - DNA, 693 bp, Homo sapiens
  misc_feature: GYAE6OF02G7X0N.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactcgaaaccagcagtgatggtggaattatactttctctgtaccaacaacaccaggacaacgaccccaaactcatactattatgagccgatcagcgcctacgacgggtctctgactcgtctctcgtcgcctccgtacgtcgtcgcacgcgaccggccctccgtcgactaacttcgtacgtcgggcctcgacgggtccgttacgggggacgtacgggtccgttaggtaattttaacgtttacgttcgttacgtttcggtttactaacggtttacggttaccggtaccggggtttagtaacggttacgggttaccggggtaccgggttaaggggggtttacgttaccgggggagggggaaaccgggtaaacgggtaaacggggttaccgggtaccccggtttaacccggtaacgggttacccggaccggtaccccgggttaagggccccgtttaccccgggtacccccgtcgggttacccc

SEQ ID NO: 168845 - DNA, 698 bp, Homo sapiens
  misc_feature: GYAE6OF02GW5H7.49.82.H05.1.454.CMB.1.raw
  modified_base (312)..(312): a, c, t, g, unknown or other
  misc_feature (312)..(312): n is a, c, g, or t
  modified_base (453)..(453): a, c, t, g, unknown or other
  misc_feature (453)..(453): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactgaaaccagcagtgatgttggaattacttaaccttttctcctaggtaacccaacaaccacccaggaccaaacgcccccaaactcactctatttangacggaccgatcgacggccggccctcgacgggtcctcgtgactcgtcttcgtcgtacgtcctccgacgtcgtggccagctccggccctcccgtagaactacgtcgtcgtcgggcctaccggacgggtcggtacggggacgnggtacttacggtaatttagttacgttgtccgtttagttacgtatttacggtcggtccgggttaggtaacgttacgggtaggggtacccgggttaaaggggttccgggttacggggtaccggggaacgggtaacccgggtaaggggttacccggtaccggttaaccggttaacgggttaccggaacccggttaccccgggaacgggttccccggttacccgggtccccccgtttacgggtaacccc

SEQ ID NO: 168846 - DNA, 597 bp, Homo sapiens
  misc_feature: GYAE6OF02FTOLT.49.82.H05.1.454.CMB.1.raw
  modified_base (291)..(291): a, c, t, g, unknown or other
  misc_feature (291)..(291): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccagcagtgatgttggaattataacctttctctgacaacaacaccagcaagcccccaatcatcatttangagccatcacgccgccctacgacgggtctctgatcgcttctctgcctccacgtcgtgcacgcaccggtccctcctgaactaactctacgtcgggcctccgagggtccgtaggggaccgcggtcttaggatttagttacgttgtctttgttactattagtcgtaccggtgtagtacggtcggtaacgggtaacgggtttggtccgggtacgggaagggaacggtaacgggtacggtacccggttaaccgtacgggtaccgacggaccccgtaagggtcccgtcccgtacccccgttacggtaccccg

SEQ ID NO: 168847 - DNA, 540 bp, Homo sapiens
  misc_feature: GYAE6OF02HD93R.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagccccaaactcatcatttatgaggccgatcagcggccctcaggggtctctgatcgcttctctggctccacgtctggcagcacggcctccctgacaatctctgggctccaggctggggaccgaggcgttgattattattgtctgtttcattatgcccggtgagtagtgggccgtaaggggtgttcgggcggaggggacgaaagggtgaaccggtccgtaggtaagcccgaacggccgtacggcccccttcgggtcctacccg

SEQ ID NO: 168848 - DNA, 619 bp, Homo sapiens
  misc_feature: GYAE6OF02GSREQ.49.82.H05.1.454.CMB.1.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctctggtaccaacaacaccagcaagcccccaaatcatcatttangaggccgatcagcggccctcgaggggtctctgatcgcttcnctgctccacgtctggcagcaccggcctcccgtgacaactctcgtcgggcctccgaggcgtggggaccgaggcttgtattagttattgtcttgttcctattacgtcggtccggttagtagttacgggtgggtacccggtaaggggttcggttaccggggacggggtaacggggaacggtaaacggggttccggtaaccccgggttacccggttaacgggttcccgaacggtaccccggtaaagggtccccgtacccggtcccccccggttccggttacccccgg

SEQ ID NO: 168849 - DNA, 629 bp, Homo sapiens
  misc_feature: GYAE6OF02GF37S.49.82.H05.1.454.CMB.1.raw
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctctggtaccaacaaccacccaggcaaacgcccccaaaccatcattangaggccatcagcgcctgacgggtctctgactcgtcttctctggctccacgtcgtgacagcaccggtcctcctgaccatctcgtcgggctccgaggtcgtgggggacaggtctggttaatttagttattgctttgttacattacgtcggtccggttagacggttaggtaccggggaccgttaagggggttcgttaccggggacgggtaacggggtaacccgtaacggggttccggaacccggtttcccggtaagggtccccgtaaccgggaccccggtaacgggttcccgttaccccgggtcccccccgttacggggtcccttaaccccgg

SEQ ID NO: 168850 - DNA, 632 bp, Homo sapiens
  misc_feature: GYAE6OF02IS9QA.49.82.H05.1.454.CMB.1.raw
  modified_base (275)..(275): a, c, t, g, unknown or other
  misc_feature (275)..(275): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
tcagagtcgagagacacgaccggtgctcgatttagtcgagctctctcgcggggggggtcacaagaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctctgcactggaaccaccaatgacgttggtacttataattctgtctcctgtaccaacaataccccgganaaacgtccccaaaactcaatgtatctttgaggtcagtgatcggcccgnagggtttccncatcgcttctccggctccaagtctggcagccacggtcctccctagacctatcctcgtcggctcccaaggctaggaggacgaggctgtaattattacgtgacagcctataataactaacaaaactaataaaaccgtacgtttaggggtaccgtttaccgggacgggtacccgggaaaccctaaaccgttaccggacccgttacccgtaaccggtaccctaaccgtaccccgaaggtcccgtaccgtaccccccgttacggttacccacccgttacccttaccggttaccccctaaccccc

SEQ ID NO: 168851 - DNA, 524 bp, Homo sapiens
  misc_feature: GYAE6OF02IO313.49.82.H05.1.454.CMB.1.raw
  modified_base (252)..(252): a, c, t, g, unknown or other
  misc_feature (252)..(252): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttntcctggtaccaacaacacccaggacaaacgcccccaaaactcatcatttatgagccgatcagcggccctcgagggtctcgtgatcgcttctctggcctccacgttctggcagcaccggcctccctgacaactctcgtgggctcgaggcgtggggacgaggctagtattattattgctgttcatatggccggttgagtagtgggacgtagggtgtcgggcggaggaccgaaggtcgaccgtcgtagagtcacgccgaagcgtcgccccgtcgg

SEQ ID NO: 168852 - DNA, 673 bp, Homo sapiens
  misc_feature: GYAE6OF02GDTV3.49.82.H05.1.454.CMB.1.raw
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (296)..(296): a, c, t, g, unknown or other
  misc_feature (296)..(296): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattataacctttcncctgtaccaacaacaccaggcaaacgccccaaactcatcatttangaggccatcagccggccctgagggtctctgatccgcttctcgtggtacctccgtacgtcgtggcctacgccgtaccggccctccctgtaacctaactcctcgtcgggtcctccgaggtccggtagggggacgacggtcgttacggttagtttaactttagttcgtcgtttacgttacgtaagttacgttcggacccgggttaggtaacgtttaacggggtcgggtaccgggttaaagggggtacgggtttccgggggtacgggtaacggggtaaaccggtaaacggggttaccggtaacccggttaaccggttacgggtacccgaccggtacccggaaacggtcccggtacccggttcccccggttacggttacccg

SEQ ID NO: 168853 - DNA, 107 bp, Homo sapiens
  misc_feature: GYAE6OF02I0SI3.49.82.H05.1.454.CMB.1.raw
  modified_base (107)..(107): a, c, t, g, unknown or other
  misc_feature (107)..(107): n is a, c, g, or t
tcagagtcgagagacacgaccggtgctcgatttagtcgagctctctcgcgggcacgaccgtgctcgatttagtcgagctctctacgcgggctggcaaggcgcatagn

SEQ ID NO: 168854 - DNA, 633 bp, Homo sapiens
  misc_feature: GYAE6OF02GTICL.49.82.H05.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (353)..(353): a, c, t, g, unknown or other
  misc_feature (353)..(353): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgcactgaaaccngcagtgatggtggaattatacctttctctgtaccaacaacaccagacaacgccccaaactcatctatttatgaggccgatcagccggccctcgaggggtctctgatcgtcttctctggcctccacgtcngcagcaccggtcctcccgtagaccaactcttcgtcgggccttccgacgggtcgtacgggggaacgagggtctggtaattttagtttaattgtcttagtttcctaattagtcggtacccgggttggtaagtagggttcgggacccggtaaaggggttcggttcgggacggggtacggggaacggtaaacggggtcggtaacccgggtttccgtaacgggtcccgtaacggtaccccggtaacgggtcccggtaccgggttcccccccgtccggttaccccg

SEQ ID NO: 168855 - DNA, 708 bp, Homo sapiens
  misc_feature: GYAE6OF02JGV3X.49.82.H05.1.454.CMB.1.raw
  modified_base (300)..(300): a, c, t, g, unknown or other
  misc_feature (300)..(300): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacaccaggacaaacgccccaaactcatcatttangaggccgatcagcggccctcgaggggtctctgactcgtcttctcgtcggtctccacggttctcggccaggccaaccgggtccctcccttagacctaaactctcggtcgggtcctcccggtaggccggtagggggaccgagggtccttaggtaactttactttagtcgtacttcgtttactacttacgtcgtccgggttgtaacgttacgggttacggggaacccgggttaaagggggttcggggttttaccggggacggggtaaacgggggtaaccggtaaaaacgggggtttacggtaaaccccgggttacccggttaacgggtttacccggaaccgggtaccccccggtaaaaggggtccccggttaccccggttacccccccgggttacccgggtttaaccccgg

SEQ ID NO: 168856 - DNA, 727 bp, Homo sapiens
  misc_feature: GYAE6OF02IE47I.49.82.H05.1.454.CMB.1.raw
  modified_base (118)..(118): a, c, t, g, unknown or other
  misc_feature (118)..(118): n is a, c, g, or t
  modified_base (139)..(139): a, c, t, g, unknown or other
  misc_feature (139)..(139): n is a, c, g, or t
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (607)..(607): a, c, t, g, unknown or other
  misc_feature (607)..(607): n is a, c, g, or t
  modified_base (615)..(615): a, c, t, g, unknown or other
  misc_feature (615)..(615): n is a, c, g, or t
tcagagtcgagagacacgaccggtgctcgatttagtcgagctctctcgcgggggggggtcacaagaggcagcgctctcggggacgtctccaccatggcctgggctctgctgctcctcnctctcctcactcaggacacgngggtccnggcccagtctgccctgactcagcctgcctccgtgtctggtctcctggacngtcaatcactatctcctgaccatagaaaccagctaaggtgtagttggtttagggtaaatttaactttaacccgtttttctcccgttacggttaaacccaaaaccaaaccgccgaacggtaaccgtaaaacgtaccccccccaaaattccgaacttaccgtaattttagttacggaaccggtaaccgctaaccggaacggaccccggggtcccttacgggtaaccggggtcccttggtaagtacttcggttccttccgttacgtcggccttaaccgtccggtccgttaggccgtacgacccgtccggttaccctttcccgaggtaacctaacgtccgtccgggttaacggcccgttaccgagggtccggtgggggaacgtcgaggttacgttattaagtttctggtaacttnttaactanagttgaccgtaggtacgtcgaacgggtgtaacgggttgtacggggaggacgggtaacacggtacgtacgggtactaggcgtacgccgtacggcttccgtaccccgtggtacc

SEQ ID NO: 168857 - DNA, 685 bp, Homo sapiens
  misc_feature: GYAE6OF02F3WZT.49.82.H05.1.454.CMB.1.raw
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtacaacacaccagacaacgccccaactnatcattangagccgatcgacgccgcctcgagggtctcngatcgtcttctcgtcgcctccgtacgtcgtcggacgacgccgacccgtccctaccgtacgaacctactccgtcggtcgggtcctccgggacgggtccgggtacggggaaccgacgggtcgttaagtacgttttaactttcgttacgtcgttttaccgttacgtagttacgttccgggtaccggttaggttaacggttacgggtaccgggttaacggggtaagggggtttccgggtttacggggaccggggtaaggggtaaaccggttaacggggtcccggtaaccccggtttacggtaaccggtaccgaccggaaccccgggtaagttccccggtcccggtaccccccggttcggttacccccg

SEQ ID NO: 168858 - DNA, 757 bp, Homo sapiens
  misc_feature: GYAE6OF02GG0K4.49.82.H05.1.454.CMB.1.raw
tcagagtcgagagacacgaccggtgctcgatttagtcgagctctctcgcgggggggtcgacgaagaggcagcgctctcgggacgtctccaccatggcctgggctctgctgctcctcactctcctcactcaggacacagggtcctgggcccagtctcgccctgactcacgcctgcctccgtgtctgggtcctccgtggacagtcgatcaccatcctcctgcactagaaaaccgacaggtgattggtaggaattattaactttctctcgtacaactacaccagacaacgaccccaaatacactactattatacggacgaccgtatacgtaacgccggtaccctaccggtagggtccttacgtacgtaacgtccgtccgttcctcgtacggttccgtaccctaccgttcgtaccggtcgagtacccccccggaacggttcccctacccgtacgaaccttaaacgtttccctcggtccgggttaccctccggaccggttacgggggtaccgggtacggaccggtgttaggtaacttttagttacttcggtacgtttaccgttactagttacgtaccggtacgtacggtaagtccgggttacgggtaaccgggttaaggggtaccggttccggggtacgggaaacggggttaacggaaaccggggttaccgggtacccggttaaccgggttacggaccggttaacccggaccgggttaaacgggccccgttaccccgggttaccccggtcccggttaacccg

SEQ ID NO: 168859 - DNA, 737 bp, Homo sapiens
  misc_feature: GYAE6OF02HSDY1.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtcctcgccctgactcacgcctcgccctccggtgtcgtgggtcctccgtggacaggtcgactccacctatcctcctgacctacgtacgaaaccagcagtgtattggttaggtaaattactttaaccttttcctccgtacggtaaccaaaccaaccaccgagaacaaccgacccccaaactctactactaatttagagaccggcctaatccacggtcccggtcccgtcggtacggggttccttcgtcgtacgtccgttccttcgttcgtccggtccttacccgaccggttcgtcggaccgacggtccggaccccggtccctcccgtagtaaccctacgttccgtcgggtcggccctccggtacgggtcgggtaggggaccgtagggtcttaagttattagttttacgtcgtacgtttcgttactagttacggtccgggtacgttagtacggttacgggtacggggtacggtaacgggggttcgggtacgggacggggtaacggaacgggtaccgggtaccgtaccgggtacgttaccggaccgtacggcccggtaaggtcccgtaccccggtccccgtcggttacccg

SEQ ID NO: 168860 - DNA, 758 bp, Homo sapiens
  misc_feature: GYAE6OF02HYWKS.49.82.H05.1.454.CMB.1.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcatcaggacacagggtcctgggcccagtctgccctgactcagcctgcctcgtgtctgggtcctctggacagtcgatccacctatctcctgactactgaaaccngcagtgattggttaggaattacttaaccttttcncctaggtaccaacaacaccgaggcaaacgccccaaatcatctatttagngagccgatccacggccggtccctcggacggggttctacgtcggtaacttccggtaccttcgtacggtcggccttacccgtaacggttccgagggtaccgaccgtaccgtacccgggtccccttcccgtaacggtaccctaaacgttccgttacgggttaccggtaccgtacccggtagggtaccggttacggggggtaccgtaacgggttcgttaacgggtaattttaacgtttacgtttcgtaccgtttacgttacgtaacgttagttacgggtaccggttagggtaaccgtttcgggttacgggaaccgggtttaacggggtttcggttaccgggtacggggaaccgggtaaccgtaacggggtaccggttaccctaccgggttaacggtccggtaaccggacccggtaacggttccgtttaccccggtacccgttaccgggtaccc

SEQ ID NO: 168861 - DNA, 107 bp, Homo sapiens; identical to SEQ ID NO: 168813
  misc_feature: GYAE6OF02H72UT.49.82.H05.1.454.CMB.1.raw
  modified_base (106)..(107): a, c, t, g, unknown or other
  misc_feature (106)..(107): n is a, c, g, or t

SEQ ID NO: 168862 - DNA, 624 bp, Homo sapiens
  misc_feature: GYAE6OF02GB5II.49.82.H05.1.454.CMB.1.raw
  modified_base (301)..(301): a, c, t, g, unknown or other
  misc_feature (301)..(301): n is a, c, g, or t
  modified_base (356)..(356): a, c, t, g, unknown or other
  misc_feature (356)..(356): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttangagccgatcagcgcctcagggtctctgactcgcttctctggctccacgtctggcngcacggcctcctgacaatctcgtcgggctccgaggcgtcggggacgaggtctggtatttagttattgcgtttgttccagttacttcgggcccggttagtaacggtttacgggtcgggacccggtaaaggggttcgtttaccggggacggggtaacggggtaacgtaaacggggttccggtaaccccggttacgttaaccggggttaccaaccgggtccccgtaaacgggcccgtttacccggtcccccccggtttacggttaaccccg

SEQ ID NO: 168863 - DNA, 744 bp, Homo sapiens
  misc_feature: GYAE6OF02IR1I1.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatccaccatctcctgcactcgaaaccngcagtgatgttaggaattataaccttttctcctggtaccaacaacacccaggacaaacgcccccaaactcactctaatttagtggacggccgtatccgacggccgtccccgtacgtaggggtcctcgtgactcgtccgttcctccgttcgggtccttaccgtaccgtcgtcgggtacgaacgccgacccggtccccttccccgtacgtaacctaaacgttccgttccggtccgggtacccgttacccgacggggtcccgggttacggggggaaacccgggacgggttccgttaaggttaaacgtttaagttttaccggttacgttccgtttacgtttactacgttagttaccgggtaccgggttagtacgttacggggtcgggtaacccgggttaaggggttccggttacggggcggggaaagggtaaccggtaagggtacccggtaccggtacccgttaacgggtaccgaacccgggtaccgtaaccgggtcctccccggtacccccggtggtaccccg

SEQ ID NO: 168864 - DNA, 110 bp, Homo sapiens
  misc_feature: GYAE6OF02HQLKP.49.82.H05.1.454.CMB.1.raw
  modified_base (107)..(110): a, c, t, g, unknown or other
  misc_feature (107)..(110): n is a, c, g, or t
tcagagtcgagagacacgaccggtgctcgatttagtcgagctctctcgcgggcacgaccggtgctcgatttagtcgagctctctcgcgggctggcaaggcgcatagnnnn

SEQ ID NO: 168865 - DNA, 632 bp, Homo sapiens
  misc_feature: GYAE6OF02FSJ3J.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctctggtaccaacaacaccaggcaaacgcccccaaactcatcatttatgaggccgatcagcggccctcgagggtctctgactcgcttctctggctccacgtctgcagcacggcctccctgacaatctctcgggctccgaggcgtggggacgaggctagtatttagttattgtacttgttacaagttagtcggtccgggttgtagttacgggttcgggacccggtaaagggggttcggttaccggggtacggggtaacggggaacccgtaaacggggtccgggtaaccccggttacccggttaaggggtttacccgaacgggttacccccggaaacggggtccccgttacccgggtccccccccggttacgggttacccccg

SEQ ID NO: 168866 - DNA, 797 bp, Homo sapiens
  misc_feature: GYAE6OF02JMQC0.49.82.H05.1.454.CMB.1.raw
tcagagtcgagagacacgaccggtgctcgatttagtcgagctctctcgcggggggggtcgacaagaggcagcgctctcgggacgtctccaccatggcctgggctctgctgctcctcactctcctcactcaggacacagggtcctgggcccagtctgccctgactcacgcctgccctccgtgtccgtggtctccgtggacagtcgataccaccattcctcctgaccacgttacgaaaacccgtgccaaggttgtaagttcgggtttagggaaatttaacttaaacctttttcctaccgttacggtaacctaaaccaacctaaccccaacgggaaccaaaccgaaccccccaaaacctaccgtaactaccttaattttactacggtacggtacccgtatccgtacgcccgggaccccttaccggacggggttcctaccgttagtaacgtcccgtactttctcgttccggtcctacccgtacgtcgttcggacgtccgtccgtaaccgtccctaccgttacgaacttactaccgtccggtccggtaccgtcggtacgggtcggtacgggggtacggtacggtacgttagtttaactttaacgttaggttccgtagtttcgtttactagtttaggtccggtccgggtataagggttacgggtacggggtaaccgtagggggttaacggttggggacccgggtaagggtaacggttaacggggtaccgtaccgggttaccgtacgggtaccaccggtaccggaaccggttccccgtccccgggtaccccgttaccgtaccgg

SEQ ID NO: 168867 - DNA, 628 bp, Homo sapiens
  misc_feature: GYAE6OF02HM9DI.49.82.H05.1.454.CMB.1.raw
  modified_base (228)..(228): a, c, t, g, unknown or other
  misc_feature (228)..(228): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgccactacgaaaccngcagtgatggttagggaattattaacctttctctgtaccaacaacaccaggacaacgaccccaaactcactctatttatagaggccgatcacgccggcctcgacgggtctctagtatccgtcttctcgtcgtcctccgacgtcgcggctagccgaccgtcctcccgtagactactcgtcgtcggctaccgnggtcgagggacgnggtgtacgtattattagtcgtctcgttanacgttagtcggtaccggtgtaacgttaggtacggggtacggtaacggggttcggtaccgggacggggtacggggtaacccggtaagggtccggtaacccggtcggttaccgggtaccgtaccggaccggtaacgggtcccgtaccggtcccccggtacgtaacccgg

SEQ ID NO: 168868 - DNA, 578 bp, Homo sapiens
  misc_feature: GYAE6OF02FG5B1.49.82.H05.1.454.CMB.1.raw
  modified_base (224)..(224): a, c, t, g, unknown or other
  misc_feature (224)..(224): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttgggaattataaccttttctcctggtaccaacaacacccaggcaaagccccccaaatcatcatttatgagccgatcagcggccctcgaggggtctctgatcgcttctctggctccacgtcnggcagcacggcctcccngacaatctcgtggctccgaggcgtgggggacaggctagatttattagttgcttgttacatagtcggaccggtgagtaggtcggaccgggtaaggggttcgttacggggcgggtaacggggaacccgtaaggggtcggaccccggttaccgtacgggtaccacgggaccccgaaacgggtccctaccggccccccgttcgggtaccc

SEQ ID NO: 168869 - DNA, 627 bp, Homo sapiens
  misc_feature: GYAE6OF02GELBH.49.82.H05.1.454.CMB.1.raw
  modified_base (224)..(224): a, c, t, g, unknown or other
  misc_feature (224)..(224): n is a, c, g, or t
  modified_base (424)..(424): a, c, t, g, unknown or other
  misc_feature (424)..(424): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataaccttttctcctggtaccaacaacaccagcaaacgcccccaaactcatcatttatgacggccgatcagccggccctcgacggggtctctgactcgtcttctcgtcgcctcccacgtctggcagccgaccggccctcccgtgacctaatctcgtcggcctccgacgggcgtcggggaccgngggccttagtatttagttattcgctttgttacattacgttcgtccggttagtagttcgggtaggaccgggtaaggggttcggttaccggggtacggggaacgggacccggtaaagggttaccggtaacccggttccggttaacgggtcccgacgtaccccggtaacgggcccgttacccggtccccccggttacggttacccg

SEQ ID NO: 168870 - DNA, 654 bp, Homo sapiens
  misc_feature: GYAE6OF02FLFF7.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataactttctcctgtaccaacaacaccaggacaaacgcccccaaactcatctattatgacggccgactcacgccggccctcgacgggtctcgtgatcgtcttccgtctcggcctccacggtctggcacggcgaccggtccctcctgaacaagtcctcgcgggtctccgacgggtcgtcgggggaacgacgggcttaggtaactttaagtttaacttcgtcttacggttactaagttacgttcgggtaccggtggtaacttagggtcgggtaaccggtaacggggttcggttaccggggacgggtaacgggggaaccgtaacggggtacgtaacccggttacccggtaacgggttaccgaacggtacccggtaaaaccgggccttacccggcccccccggtttacggtacccg

SEQ ID NO: 168871 - DNA, 126 bp, Homo sapiens
  misc_feature: GYAE6OF02IODL0.49.82.H05.1.454.CMB.1.raw
  modified_base (107)..(107): a, c, t, g, unknown or other
  misc_feature (107)..(107): n is a, c, g, or t
  modified_base (109)..(109): a, c, t, g, unknown or other
  misc_feature (109)..(109): n is a, c, g, or t
  modified_base (111)..(126): a, c, t, g, unknown or other
  misc_feature (111)..(126): n is a, c, g, or t
tcagagtcgagagacacgaccggtgctcgatttagtcgagctctctcgcggcacgaccggtgctcgatttagtcgagctcgtctcgcggctggacaaggcgcatagngncnnnnnnnnnnnnnnnn

SEQ ID NO: 168872 - DNA, 215 bp, Homo sapiens
  misc_feature: GYAE6OF02G2G9G.49.82.H05.1.454.CMB.1.raw
  modified_base (213)..(215): a, c, t, g, unknown or other
  misc_feature (213)..(215): n is a, c, g, or t
tcagagtcgagagacacgaccggtgctcgatttagtcgagctctctcgcgggcacgaccggtgctcgatttagagagagtgtggttgggtttggggggaagaggaagactgacggtcccccaggagttcaggtgctgggcacagcggccctgggctgcctggtcaaggactacttcctctctcgactctgagcgggctggcaaggcgcatagnnn

SEQ ID NO: 168873 - DNA, 599 bp, Homo sapiens
  misc_feature: GYAE6OF02FVD60.49.82.H05.1.454.CMB.1.raw
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccagcagtgatgttgggaattataacctttctctgtaccaacaacaccagcaaacgccccaactcatcatttangagccgatcagcggccctcgagggtctctgatcgcttcnctggctcacgtctcgcagcgaccgcctccctcgaaccaatcctcgtcgggctccgaggcggtggggaccgaggtctagtatttagttattcgtcttgttctattacgtcggtacgttcgagttacggtggtacccgggtaaaggggttcggttaccggggacgggtaagggtaacggtaaacgggtcgtaaccccggttcggtaacggttaccgaccggtaccccgtaaacggtcccgtacccggtcccccggtaggttaccccg

SEQ ID NO: 168874 - DNA, 613 bp, Homo sapiens
  misc_feature: GYAE6OF02GQTSQ.49.82.H05.1.454.CMB.1.raw
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
  modified_base (441)..(441): a, c, t, g, unknown or other
  misc_feature (441)..(441): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatggttagggaattataaccttttctcctggtaccaacaacaccaggcaacgccccaaacncatcatttatgagccatcagcgccctgcgggtctctgatcgcttctctcggctcctacgtctgcacgcgaccggccctccgtgaactatcctcgtcggtcctccgacggcggtacgggacggcggtacgttcgtatttacgttattcgtnttcgttactataacggtcggtaccggtagtagttcgggtaggtaaccggtaagggttcggttaccggggcgggaacggggtaacggtaaacggggtccggttacccggtaccggttacggtaccgacggtacccggaaggtcccgtcccggtcccccggtacggttacccgg

SEQ ID NO: 168875 - DNA, 947 bp, Homo sapiens
  misc_feature: GYAE6OF02FSLL9.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacgacgggtccgtcgggcccagtctcgcccgtgacctcacgcctcgccctccggtgtcgtcgggtccctcgtacgacgtcgtactactaccacctactcccttccgcacctacgtaaaccgaaaccgcgacgtaggtagtaggtttacgggttaaaggttaacttttaaacccttttaccctttcccgttaccggttaacccgtaaacccaaaacccgaaaccccgaaccggaacgaaaaccccgtaaaccccccgtaaacccccctaaactaacctaccttaacttttaaacgttaggtaacgggacccggtaacctaccgtaccggacccgggtcccccgtacccggttacggggtaccggttccttacggtagttacccgtcctttccttaccgtcggtccgtacccttaccggtacgtcggtaccgacgaccgacccggtacccgtccccgtacgtacgaaccttacgttccggtacgggccccggtaccctacggggtacgggttaccggggggaaccgggtaccggttacggtgtttaaagtttactttttaaagttccggttcgtttccgtttaacggttattaacgggtccgggttcccggggttaggttaagttaacggggtaccggggtacccgggtaaacggggtttgggtttccggggaacgggggaacgggtaaacggtaaaccgggttaccggggacccttttaaccccgggtagggaacgggtaccccgaacccgggtaacccggttaccccgggttccccggtaccccccccgggtttacgggtacccttaaccccgg

SEQ ID NO: 168876 - DNA, 314 bp, Homo sapiens
  misc_feature: GYAE6OF02GG7PD.49.82.H05.1.454.CMB.1.raw
  modified_base (289)..(314): a, c, t, g, unknown or other
  misc_feature (289)..(314): n is a, c, g, or t
tcagagtcgagagacacgaccggtgctcgatttagtcgagctctctcgcgggcacgaccggtgctcgattagtcgagctctctcgcgggcacgaccggtgctcgatttagtcgagctctctcgcgggcacgaccggtgctcgatttagagagagtgtgttgggtttggggggaagaggaagactgacggtccccccaggagttcaggtgctgggcacagcggccctgggctgcctggtcaaggactacttcctctctcgactctgacgcggctggacaaggcgcatagnnnnnnnnnnnnnnnnnnnnnnnnnn

SEQ ID NO: 168877 - DNA, 599 bp, Homo sapiens
  misc_feature: GYAE6OF02IYSAW.49.82.H05.1.454.CMB.1.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttagggaattataaccttttctctggtaccaacaacaccaggcaaacgccccaaatcatcattangaggcgatcgagccggcccngagggtctctgatcgcttctctggctcacgtcncgcacgcacggcctcctgacaatcgtcgtcggtctcgagcgtggggacgaggtctagtatttacttagttcgcttagttctatagtgtaccggttgagttacgtcgggaccggtaaggggtcggttacgggacgggtaacggggtaaaccggtaaacgggttcggtaacccggttacggttaacgggtaccgtaacggaccccggtaaacgggtcccgtacccggttcccccggtaccggttacccg

SEQ ID NO: 168878 - DNA, 173 bp, Homo sapiens
  misc_feature: GYAE6OF02F6YKB.49.82.H05.1.454.CMB.1.raw
  modified_base (166)..(173): a, c, t, g, unknown or other
  misc_feature (166)..(173): n is a, c, g, or t
tcagagtcgagagacacgaccggtgctcgatttagtcgagctctctcgcgggcacgaccggtgctcgatttagtcacgcgagaaagggaaagggggctggccctgacgtgtttctgttcccgccctcctctctctcgactctgagcgggctggcaaggcgcatagnnnnnnnn

SEQ ID NO: 168879 - DNA, 674 bp, Homo sapiens
  misc_feature: GYAE6OF02GP4IB.49.82.H05.1.454.CMB.1.raw
  modified_base (226)..(226): a, c, t, g, unknown or other
  misc_feature (226)..(226): n is a, c, g, or t
  modified_base (316)..(316): a, c, t, g, unknown or other
  misc_feature (316)..(316): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccatctcctgcactagaaaccngcagtgagtggttaggtaattaattaaccttttctccgtacggtaaccaacaaccaccaggaccaaacgacccccaaactcatctattangacgccatcacgccgccctacgacgggtctctgtactcgtcttcgtctcggcctccgtacgtcgtcggcctacgccgaccggtccctcccgtacgaacctacttcgttaccggtcgggtccctacccggtagggccgggtaacgggggaccggtacgggtcgttacggttaatttactttacgttcgtacgtttcgttactagttacgttcgggtcggtagtagttacggtcgggtaacggtaggggttgggttaccgggagggaacggggtaacggtaacgggtacggtacccggttacggtacggtaccgacgacccggtaacggtcccggtacccggtccccgtacggttacccg

SEQ ID NO: 168880 - DNA, 166 bp, Homo sapiens
  misc_feature: GYAE6OF02IAXRX.49.82.H05.1.454.CMB.1.raw
  modified_base (157)..(166): a, c, t, g, unknown or other
  misc_feature (157)..(166): n is a, c, g, or t
tcagagtcgagagacacgaccggtgctcgatttagtcgagctctctcgcgggcacgaccggtgctcgatttagtcacgcgagaaagggaaggggctggccctgacgtgtttctgttccccgcccttcctctctctcgactctgaggcggctggcaannnnnnnnnn

SEQ ID NO: 168881 - DNA, 673 bp, Homo sapiens
  misc_feature: GYAE6OF02I14Q2.49.82.H05.1.454.CMB.1.raw
  modified_base (311)..(311): a, c, t, g, unknown or other
  misc_feature (311)..(311): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactacgaaccagcagtgatgttaggaattattactttctctgtaccaacaacaccagacaacgacccccaaatcatctatttagtgacggacgtancgacgccggccctacgacgggtctctcgacgtcgtaccttcgtctcggtcctaccctacgtcgtcgaccgacgtaccgacccggtcccttaccgcgtaaaccgacttccgttcgtcgggtaccttcccgagggtccggtcggggaacggcggttaccttaggtaattttacgttacgtccggactacggtacttcgaacttaaataacccaaaattacgtaaaccgttacggttcgggtacgggttaccgggcccggggtaaccgaacccttaagggtcccggttaacccgttaccggtaccgaccggtacgaacccggtacggttacccgtcccggtacccccggtagttacccgtacccg

SEQ ID NO: 168882 - DNA, 549 bp, Homo sapiens
  misc_feature: GYAE6OF02G69A4.49.82.H05.1.454.CMB.1.raw
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctgaggggtctctgatcgcttctctggcctccacgtctggcagccacggccctccgngacatctcgtgggcctccgaggcgtgggggacngggtctagtatttacttattgcttgttcattagtgtccggtgagttaggtcggaccggtaagggttcgtacgggcgggaggaccgtaagggtcgacccgtcgtacggtcgacggcccgaaggtcctcggtcccctggtacc

SEQ ID NO: 168883 - DNA, 728 bp, Homo sapiens
  misc_feature: GYAE6OF02G6K18.49.82.H05.1.454.CMB.1.raw
  modified_base (227)..(227): a, c, t, g, unknown or other
  misc_feature (227)..(227): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgacctcagcctgcctccgtgtctgggtctccgtggacagtcgatcaccatctcctgcactagaaaccngcagtgatgttgtacttataattctgtctcctagtaccaacaactaccccggacaaacgtaccccaaactctatgtatctttggaggtcagtgacgtccggacccgtcgtagggggtttctcgtactccgtcttccgtcccgggtccttaccgaacgttccgtggaccacggtccaccgggtccccttcccgtacgaccctacgttccgttccggtcgggtccctaccggacggtccgttagggacgggtaacgacgggtaccgttgtaaacgtttaacttaccgtacgtacctaccggtctaccgtaaacttaactaaaccaaaacgttaaaccttaaaacgtacgggtttacgggttaccggttaccggggacccggggtaccgggtaaacccctaaacggtacccggtacccggttaccgttaaccggacccgtaacgaccccggtaaccgggtacccgttccccggtaccccccggttcggtaccccgttaccccgg

SEQ ID NO: 168884 - DNA, 557 bp, Homo sapiens
  misc_feature: GYAE6OF02FRUZW.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccatcagcgccctcaggggtctctgatcgcttctctggcctccacgtctggcagcacggccctccctgacaatctcgtcggctccagggcgtggggacgaggcgttgatttattattcgtcttgttcattagtcggtaccgtgtagttacggtggaccggtaaggggttcgtcgggcgggagggaccgtaagggtcgacccgtccgtaggtaccgacggcccaagggccctcggtccccccgtaggttcccg

SEQ ID NO: 168885 - DNA, 668 bp, Homo sapiens
  misc_feature: GYAE6OF02G47MZ.49.82.H05.1.454.CMB.1.raw
  modified_base (299)..(299): a, c, t, g, unknown or other
  misc_feature (299)..(299): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccagcagtgatggttaggaattacttaccttttctctagtaccaacaacaccagacaacgccccaaatcatcatttangacggccgatcgagccggccctgacgggtctcgtgacgtcgtcttctcgtcggccttcccgacgttcgtcggacctacggccgacccggtcccttcccgtagacctaacttcccgttaccggcgggtaccctcccgaggggtccggtacgggggaaccgacgggtccttagttaattttacgttagttcgtctttgttactagttacggtgtccggttagtacgttagggtacggtaccgggtaaggggttccgttacggggacgggtaacgggtaacggtaagggtaccggttaacccggtacggttacggtacccgtaccggtacccgtaacgggtcccgtccccggtcccccgttacggtaccccg

SEQ ID NO: 168886 - DNA, 640 bp, Homo sapiens
  misc_feature: GYAE6OF02J2Y2L.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagctagtgattgttaggaattattaaccttttctcctacggtaccaacgtaaccaccaacgtacaaacgcccccaaactcatctattatgacgccgatcacggtccgcctcgacggggtctcgtgactccgtcttcctcgtcggtcctccgtacgtcgtcggcacgcgacccggcctccctagactaactcgtcgtcggccttccgacgggtccgtaggggaccgtaggtcttaggtagttactttagttcgtcttaggttcctagttactcggtaccggtggttaacgttgggtacgggtacccgggttaggggttcgttaccgggacgggaacgggtaacggtaacggtcggtacgtacccgtaggtaaccgtacgtaccccgaagtcccggtaccgtaccccccggttgtacccg

SEQ ID NO: 168887 - DNA, 645 bp, Homo sapiens
  misc_feature: GYAE6OF02HJ5JJ.49.82.H05.1.454.CMB.1.raw
  modified_base (367)..(367): a, c, t, g, unknown or other
  misc_feature (367)..(367): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaacacccagacaaacgcccccaaactcactctatttatagaggccgatcagccggcctcaagggtctactgactcgccttctctcggcctccacgtctggacncgcaccggtcctcccgtgaccaatcctcgtcggtctccaaggtcgtggggacgacggtcgttagtaactttattacgttgtccttgttacaattagtcggaccggttgtaagttacggtacgggtaccggtaacggggttgggttacggggccgggtaaacgggggtaaccgtaacgggttaccggtaacccggtttacccggtaagggtaacccgtaccggtaaccccgtaacggggttaccgtaccccgggttaccccccgttcggttaaccccgg

SEQ ID NO: 168888 - DNA, 642 bp, Homo sapiens
  misc_feature: GYAE6OF02JG7P9.49.82.H05.1.454.CMB.1.raw
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (420)..(420): a, c, t, g, unknown or other
  misc_feature (420)..(420): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactgaaaccngcagtgatgttggaattataaccttttctctggtaccaacaacaccaggacaaacgccccaaatcatcatttangacggcatcagccgcctcgagggtctctgactcgtcttcncgtcggctccgtacgtcgtgtcacgccgacggtccctacctacgactaactctcgtcggcctacgtcggcggtcggggacgnggcttagtattattgttcgtcttcgttactagttacgtcggtaccggttgtaaggttacgggtcggtaccgggtaaggggtttcgggttacccggggtagggtaaccgggtaacggtaaacggggttaccggtaccccggttaaccggttccgggttaccgtaaccgggtaacccgtaaccgggtcccgtacccggttccccccggttaccggttaccccgg

SEQ ID NO: 168889 - DNA, 569 bp, Homo sapiens
  misc_feature: GYAE6OF02IR4M1.49.82.H05.1.454.CMB.1.raw
  modified_base (334)..(334): a, c, t, g, unknown or other
  misc_feature (334)..(334): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatgttaggaattataaccttttctcctggtaccaacaacacccaggcaaagcccccaaactcatcatttatgaggccgatcagccgccctgagggtctctgntcgctctctcggctccacgtctgcagcacggccctccctgacaactctcgtcggctccgaggcgtggggaccgaggctgtatttagttattcgtctgttcattagtcggtccggtagtagtaggtcgggaccggtaaggggttcggttacgggcgggaagggacggtaaagggtcggtaaccggtccgtaggtaccgacggacccgtaaggccgtccgtccccccggtgtacccg

SEQ ID NO: 168890 - DNA, 530 bp, Homo sapiens
  misc_feature: GYAE6OF02G8J62.49.82.H05.1.454.CMB.1.raw
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgtggaattatacctttctctgtaccaacaacaccagacaacgccccaaatcatcattatgagccgatcagcgccctcgacgggtctctgatcgcttctcgtgctccacgtctgcagcgacgcctcctgactatctcgtggctccgaggcgtaggggacgaggtctgtatttatagttgctagttcagtagtgcggtnagttagngggaccgtaagggtcgttcgggacgggaggacgtaagggtcgtaccgtacgtacggtcgaacggccgaacggccctcggtaccccgtggtaccc

SEQ ID NO: 168891 - DNA, 563 bp, Homo sapiens
  misc_feature: GYAE6OF02FS6VG.49.82.H05.1.454.CMB.1.raw
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccagcagtgatgttggaattataacctttctctggtaccaacacaccagcaaacgcccccaaactcatcatttatgaggccatcagccggccctcgaggggtctcgtgatcgtctctctggctcacgtcnggcagcacggcctccngacatctcgtcggctcgngcggtaggggacgnggcgtgatttattagttcgtcttgttanattagtcggtaccggtgagttaggtcggacggtaagggtcggttacgggcgggtaagggacggtaaaggtcggacccgttaccggtaggtaccgacggtacccgaacggtcccgtccggtcccccgtcggtaccg

SEQ ID NO: 168892 - DNA, 706 bp, Homo sapiens
  misc_feature: GYAE6OF02JYV0G.49.82.H05.1.454.CMB.1.raw
  modified_base (238)..(238): a, c, t, g, unknown or other
  misc_feature (238)..(238): n is a, c, g, or t
  modified_base (334)..(334): a, c, t, g, unknown or other
  misc_feature (334)..(334): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtcgtgggtctccgtaggcctagtcgactcaccattcctcctgacactgaaaccagcagtnatgttgggaattagttaaccttttcgtacctgggttaaccaactaaccacctagggaccaaacggacccccaaaactctacgtacctattttaacncgaacggtcccgtaatacccgacggcccgggtaacccctggtaccggggttctaccgtgaacgttcccgtcctttacgaccgttcggccttaccccgacggttcgtacggggctaacgccggtaccggccctacccgtaggtaccaactaccgttcgtcgggtcctccggtacggtcgggtacggggtaccggagggtccttaggtaacgtttacgttagttcgtcgtacgtttacgacgtacgttcggaccggttgtacgttacgggtcggaaccggtaggggttccgtacgggcgtaccgggtaaccggtaaggtcgtaccggtcgtacggtcgaacgtccggaaggccctacggtccccggtagtcccg

SEQ ID NO: 168893 - DNA, 703 bp, Homo sapiens
  misc_feature: GYAE6OF02FYMHR.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtggaattataacctttctctgtaccaacaacaccaggcaaacgcccccaaactcatcatttatgaggccatcacgccgccctcgacgggtctctgactccgtcttctcgtcggtcctccgtacgttcgtacggcacgccgaccggtccctcccgtagaacctaacttccgtacggtcgggtcctaccggacgggtccgggttagggggaaccggtacgggtccgttaggttaacttttagtttaacgttcggtccgtttacgttactaacgttagttccgggtaccggttagtaggttaacgggtcgggtaacccggggttaaggggtttcgggttaccggggtacgggtaaggggtaccggtaaaaggggttccggtaccccgggttaccggtttaaccgggtacccgaaccggtaccccggtaacggggttccctaccccgggtaccccccggttacggttaaccccg

SEQ ID NO: 168894 - DNA, 167 bp, Homo sapiens
  misc_feature: GYAE6OF02GQGZF.49.82.H05.1.454.CMB.1.raw
  modified_base (164)..(167): a, c, t, g, unknown or other
  misc_feature (164)..(167): n is a, c, g, or t
tcagagtcgagagacacgaccggtgctcgatttagtcgagctctctcgcgggcacgaccggtgctcgatttagtcacgcgagaaagggaaaggggctggccctgacgtgtttctgttcccaccctcctctctctcgacctgagcgggctggcaaggcgcatagnnnn

SEQ ID NO: 168895 - DNA, 579 bp, Homo sapiens
  misc_feature: GYAE6OF02I3W9Y.49.82.H05.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattatactttcnctgtacaacaacaccagacaaacgccccaaactcatctatttatgacggccatcacgccgccctgacgggtctctgactcgtcttctcgtcggtctcacgtctggctagccaccggcctccagactactctcgtcggctcgaggcgtgggacgagtctagttattattcgttcgtcgttcgttacagttacgtcggtcgtagtacgttagggtcggtaccggttaagggtcggttcgggacgggtagggtaacgtaaacgggtcgtacccggttacgtacggtaccgtacggacccgtaaggtcccgtcccgtaccccggtcgtacccg

SEQ ID NO: 168896 - DNA, 621 bp, Homo sapiens
  misc_feature: GYAE6OF02GOWNE.49.82.H05.1.454.CMB.1.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataactttctctgtaccaacaacaccaggacaaacgccccaaactcatcatttangacggccgatcacgccggccctcgagggttctcgtgactcgtcttctcgtcggctccgacgtctggcacgccgaccggccctaccgtgaacctaatcctcgtcgggtcctccgagggtcggtgggggacgaggtcgttagtatttagttagttcgtcttgttactaagttagtcggtcggtagtagtacggtacgggtaccggtaagggtcgggttcggggacgggtaacggggaacggtaaacggggtccggtaacccggttaccggtaacggtaccgaccggtacccggaacggtcccgtcccggtcccccgtacggtacccg

SEQ ID NO: 168897 - DNA, 607 bp, Homo sapiens
  misc_feature: GYAE6OF02G6B2N.49.82.H05.1.454.CMB.1.raw
  modified_base (289)..(289): a, c, t, g, unknown or other
  misc_feature (289)..(289): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactgaaaccagcagtgatgtggaattatactttctctgtaccaacacaccagacaacgccccaactcatctattanacgagccgatcagtcgccctcgacggggtctcgtgtatcgtcttcgtctcggctccacgtcgtggcagccaccggcctacctagaccaacttccgtacgtcgggccttccggaggtccggtaggggaccgaggtcgttaggtaactttagtttagttcgtcttcgttacgagttacgtcggtccggtgtagttacggttcgggtaccggttaagggtcggttaccgggcgggtacgggtaaccggtaacgggtacggtaccggtaccggtaacggtccgacggtaccgtacggtccgtcccggtcccggtcgtacccg

SEQ ID NO: 168898 - DNA, 656 bp, Homo sapiens
  misc_feature: GYAE6OF02HNTG7.49.82.H05.1.454.CMB.1.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactagaaaccngcagtgatggttaggaattataaccttttctcctggtaccaacaacaccagacaaacgccccaaatcatcatttangaggccgatcacggccggccctcgacggggtctcgtgatcgtcttctcgtcggccttcccgacggtctcggtacacggccaccgggtccctcccgtagaacctaacttccttcgtcgggcctccgacgggtcggtagggggacgaggcgtagtatttattacgttgtcgtttgttacgagttagttccgggtcgtaggtaacgttaggggttacgggaccggtaagggggtttcgggttaccgggggacgggtaacggggtaaccggtaagggttcggtaacccggttccggtaacgggtacccaacgggtcccggaaaccgggtcctacccgggtcccccgtaggttaccccg

SEQ ID NO: 168899 - DNA, 748 bp, Homo sapiens
  misc_feature: GYAE6OF02HTXHO.49.82.H05.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgacactacgaaacngcagtgatggtggtaattataacctttctctcgtaccaacaaccaccgagacaacgaccccaaactcactctatttagtgacggacgtactcgacggccgccctcgaggggtcctcgtcgacgttacgtccttcgtcgtcggtacctaccgtacgtccgtcgaccgtacggccgacccggtccttacccgtacggtaactaaccgtttccgtaccggttccggccgttacccgacgggtcggtacgggggacgtacggtacgttgtttaaacgttacgtttaagttcgtacgtttcgttacgtaacgttacggttacggtcgggttaacgtacgttaggggtaccgggtacccgggttaaggggtttccgggttaacccggggtggggaaaccggggttaaccggtaacggggtaccggttaacccgggttacccggtaacgggttcccgtaacccgggtaacccgggtaaccgggttccccggtttacccccggtaccccccggttcggttaaccccccgg

SEQ ID NO: 168900 - DNA, 638 bp, Homo sapiens
  misc_feature: GYAE6OF02JSQXV.49.82.H05.1.454.CMB.1.raw
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
tcagagtcgagagacacgaccggtgctcgatttagtcgagctctctcgcgggggggtcgacgaagaggcagcgctcgtcgggacgtctccaccatggcctggctctgctgctctcactctcctcactcagacacaggtcctggcccagtctgccctgactcagcctgcctccgtgtctgggtcctcctggactagtcgatccacngtctctgctactgaaaccngcagtgatcgttggaattataaccttttctccgtaggtaaccaacaaccaacccgaggtccaaaacgccccctaaaactccaaagtcctaattttacagacgggtacctaactccgaagccggtacccctagacggggttcctcgtgtacgtcggtccttctcgtacggccctcgcgttcgcgggtcacgacgtcccggtaccgtccgtaacgtacgaactcctacggtcgggtctaccgtcgggtcgtcgggaaccgtgccgtagtacttaagtcgttcgtcgtacgttctaatgtcgacgtgagtggtacggacggtaggtacgttgggcgtagggactaacggtacggaccggttaccgttaacggtcgtacgacccggtaacgtccggtccgtaccccggttcgtacccg

SEQ ID NO: 168901 - DNA, 656 bp, Homo sapiens
  misc_feature: GYAE6OF02FTP0H.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctcctgtaccaacacaccagcaacgccccaactcatcatttatgacggcgatcagccggcctcgagggtctctgatcgcttctctggcctcacgtcgtggcacgcgaccggtccctcccgtacgacctaacgtctcgtacgggtcctccgacggtccggtgggggaccgacggtcgtagttacgtttatttagttcggtctttacggttctaacgttagttcggtacccgggttaggtaacgttacgggttacgggtaccgggttaagggggtttcgggtttacccggggtaccggggtaaggggaaccggtaaaacggggtaccggtaacccgggttaccgtacggttaccgaaccgggtaccccgaacgggtcccgtacccggtccccccggttacggtacccg

SEQ ID NO: 168902 - DNA, 219 bp, Homo sapiens
  misc_feature: GYAE6OF02FYU91.49.82.H05.1.454.CMB.1.raw
  modified_base (214)..(219): a, c, t, g, unknown or other
  misc_feature (214)..(219): n is a, c, g, or t
tcagagtcgagagacacgaccggtgctcgatttagtcgagctctctcgcgggcacgaccggtgctcgatttagagagagtgtggttgggtttgggggaagaggaagactgaccggtccccccaggagttcaggtgctgggcacagcggccctgggctgcctggtcaaggactacttcctctctcgactctgagcgggctggcaaggcgcatagnnnnnn

SEQ ID NO: 168903 - DNA, 765 bp, Homo sapiens
  misc_feature: GYAE6OF02JVP4X.49.82.H05.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctctcgcggggggggtcgacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgccactagaaaccngcagtgatgttaggaattattaacctttctcctaggtaaccaacaacctaccaggactaaacgcccccaaaactcaatacaatttacgtagacgggcctaagtcgaacggtccgggtacccccttacgggtaacgggggttccttaccgggttagtaaccgttccggtccttttccttccggttcgggtcccttacccctaccgggtttcttcgggaccgtaacggccccggtaacccggtccccttacccgttaggaacctaaccttccgtcgtccgggtcctaccggtacggtcggtagggggaccgacggtcgttagtagtttaattacgttgtaccgtttcggttacaaggtttacgtaccgggtaccgggttagtacggtttacgggacgggttacccgggtaaggggttcggtttaccgggacggggttaagggtaaccgtaaacggggttacgtacccggttacggttaaccgggtacgaaccggtacccggacggttacccgtccccgggtacccccgttagggtaccc

SEQ ID NO: 168904 - DNA, 662 bp, Homo sapiens
  misc_feature: GYAE6OF02IPCUB.49.82.H05.1.454.CMB.1.raw
  modified_base (228)..(228): a, c, t, g, unknown or other
  misc_feature (228)..(228): n is a, c, g, or t
  modified_base (335)..(335): a, c, t, g, unknown or other
  misc_feature (335)..(335): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtcctcctggacagtcgatccactatctcctgccactagaaaaccngcagttgattggttagggaatttacttaaccttttctaccgttaggtaaccaaactaccaacccgaggtacaaaaccgcccctaaaacgtccactacctatttacgngaacggcctagtcaacggccgtacctcggtagggtcctacgtcgtactccgtacctttcctcgtcggccttaccgacgtcttcgggactaacgcccggtaccgccctccgtagacctaactcgtcggtacggcctcccgaggtcggttacggggacggtaggtcttacgtatttacgttacgttacgcgttacgtactagttacgcggtccggttagacgttagcgggtacgagggttgtaccgggcggtaacgggtaacgaacggtaccggccgttaaccggtaggtcgaaccggccaaggtccgtacccggtcccgttcgtaccg

SEQ ID NO: 168905 - DNA, 638 bp, Homo sapiens
  misc_feature: GYAE6OF02HYZFV.49.82.H05.1.454.CMB.1.raw
  modified_base (223)..(223): a, c, t, g, unknown or other
  misc_feature (223)..(223): n is a, c, g, or t
  modified_base (487)..(487): a, c, t, g, unknown or other
  misc_feature (487)..(487): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcacatctcctgcactagaaaccngcaagtgagtggtaggtaattattaacctttctccgtagtaccaacaacacccaggaccaaacgccccaaactcatactaatttagagtacggccgtactcgaacgccggtacccgtacgtaggggtcctcgtagtacttccgtcttccttctacggtcctcctacgtcgtcggtcgacgccgaccgtcccgtccctacgaacactcgtcgtcggtctcgaggtcggtagggaccgtggtacttgtaattattgttgtacgttnttacgtagtagtccggtacgtaggtagttacggtcgggaaccgtacgggttaggttccgggacgggaacgggaacgtaagggtccgtacccggtacgtaacggtaccgacggacccggtaaggtcccgtacccgtccccgtacggtacccg

SEQ ID NO: 168906 - DNA, 680 bp, Homo sapiens
  misc_feature: GYAE6OF02GCZ17.49.82.H05.1.454.CMB.1.raw
  modified_base (227)..(227): a, c, t, g, unknown or other
  misc_feature (227)..(227): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactacgaaaccngcagtgattgttgtagtaatttacttaacctttttctcctggtaaccaacaaccacccaggaccaaaccgacccccaaactcactactatttagtgacggcctatcacggccggccctcggacggggtctctgactcgtctttctcgtggtcctaccgtacgtcgtcggcacggccgtacccgggtccctacccgtagtaacctaacgttccgtccgtcgggcctccggaacgggtcgggtacgggggaccgtaggtccgttagtatttagttacgttgtacgttcgttacgtacgttacgtcggtccggttagtagttacgggtcgggtacgggtacgggggttcggttacggggacgggtacggggtaaccggtaacgggttaccggtacccgttaccgggtacggtaccgacggaccggtacggtcccggtacccggtcccccgttcggg

SEQ ID NO: 168907 - DNA, 798 bp, Homo sapiens
  misc_feature: GYAE6OF02JETIX.49.82.H05.1.454.CMB.1.raw
tcagagtcgagagacacgaccggtgctcgatttagtcgagctctctcgcggggggggtcgacaagaggcagcgctctcgggacgtctccaccatggcctgggctctgctgctcctcactcctcctcactcaggacacgagggtcctgggcccagtctcgccctgactcagcctcgcctccgtgtcgtgggtctccgtggacagtcgatccaccatctcctgctactacgaaaccagcaagtgagtggttaggaactttattaacccgttttctacccgtacggtaaccctaaaccaaccgtacccgaaggaaccctaaaaccgacccccccaaaacttacccaattaccctaaagtttttacgacggtaaccggacccgtactccgtaaccggcccggtacccccgttcggtaacggggttccctacggttctaaccgttccggtcctttcttccggtcggtcccgtttccgaccgttcggttacggaccgacggtacccgtacccggtccccttacccgacgtaacctaaccgttccgttccgtacggggtccctaccggtacgggccggttacggggggtaccgtacgggtacgtacggtttaacgtttacgttacgttcgttcttacggtttcgtaagttccgttacgggtccggtagttacggttcgggtacgggtcggtaaagggggttcggttaacgggacggggtaacggaacgggtaacggtaccgaccggttccggtacggtaccggtacgaccggaccggtccgtcccggtcccgttaccggtacccg

SEQ ID NO: 168908 - DNA, 729 bp, Homo sapiens
  misc_feature: GYAE6OF02IGE82.49.82.H05.1.454.CMB.1.raw
  modified_base (227)..(227): a, c, t, g, unknown or other
  misc_feature (227)..(227): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgcactacgaaaccncgcagtgtagttggttagggtaatttaacttaaccttttctccgttacggtaaccaaacaaccaacccaggacaaacgacccccaaactccatctatttagtgacggcatcacgccgaccctcgacgggtctacgtgacgtcgtcttctcgtcggtcctcgtacgtcgtacgcgacgaccgtcccggtccgttaccctacggaaaccctacgttacccgttccggttacggggccctttacgggaaccggggtccggttacggggggacccgggtaaggttaccggttagttaacgttttaacggtttacggtttcgaccgtttttaggtaccttaaaggttcgttacgggaccgggtttagaacggttcggggttacggtaacgggggtacgggttcgggttacgggacgggggtaacggaaccgggtaacgggtaccggtaccggttccgaaggtcccgaacggtcccgaaggtcccctaccggtccccggtacgttccg

SEQ ID NO: 168909 - DNA, 167 bp, Homo sapiens; identical to SEQ ID NO: 168235
  misc_feature: GYAE6OF02GEO6M.49.82.H05.1.454.CMB.1.raw
  modified_base (165)..(167): a, c, t, g, unknown or other
  misc_feature (165)..(167): n is a, c, g, or t

SEQ ID NO: 168910 - DNA, 722 bp, Homo sapiens
  misc_feature: GYAE6OF02HZ3F3.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcactagaaaccagcagtgagttggttagggtaaattattaacccttttctacctggtaccaaacaacctaccaggacaaacgacccccaaactacatactattttatagacggtaccatcacggccggccctcgacgggtcctcgtgactcgcttctcgtggtcctacctacgtcgtcggctacgaccgaccggtccctccctaggaacctaacttccgttaccggtcgggaccctacccggacgggtccgggtacggggaccggtacggtcgttagttaagtttacgtttacgttacggtacctttcggttactaagttacgttccgggtaccggttaaggtaacgttagggtaccgggtaaccggttagggggtttccgggttaccggggacggggtaagggtaaccggtaaagggttcccgggtaacccggttaccggtacgggttacccgaaccgggtacccgaacgggtcccgtacccggtcccccggttacggttaccccgg

SEQ ID NO: 168911 - DNA, 730 bp, Homo sapiens
  misc_feature: GYAE6OF02ION91.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattattaaccttttctcctaggtaaccaacaacacccgaggaccaaacgacccccaaaactcactacctatttaacgtggacggccgattcacggtccggccctacggaggggtcctgtacgatccgtcttccgtcgtcggtcctccgtacgtccgtggaccagccgaccggtccctcccgtagaacctacgtaccgtcgtcggcctacggtacgggccggttagggggaccgtacggtacgttacgttaatttagtttacgttcgtaccgttgtttacgaaggttacgttcggtacccgggttagtaacggttacgggttaaccgggaccgggttaaagggggttccgggtttaccgggggaccggggtaacggggtaaccggtaaacgggttaaccgggtaacccggttacccggttaacgggtaccgtaaccggaccccggtaacgggtaccccggttacccggtaccccccggttacgttaccccgg

SEQ ID NO: 168912 - DNA, 718 bp, Homo sapiens
  misc_feature: GYAE6OF02JTBSG.49.82.H05.1.454.CMB.1.raw
  modified_base (239)..(239): a, c, t, g, unknown or other
  misc_feature (239)..(239): n is a, c, g, or t
tcagagtcgagagacacgaccggtgctcgatttagtcgagctctctcgcgggggggtcgacaagaggcagcgctctcgggacgtctccaccatggcctgggctctgctgctcctcactctcctcactcaggacacgagggtcctgggcccagtctcgccctgactcagtcctgcctccgtgtcgtgggtctcctaggacacgtcgatcaacctatcctccgtgcctactacgaaaaccngccaagtgagttgttagggaatttacgttaaaccttttctccgtacggtaaccaaacaacctaaccgaaggacaaaccgcccccaaactacctactaccgtaattacgtacgaagggtccaactccgaacgccgtaccgttacggacgggtcctacgtacgacttccgtcgttcttccgcggtcctcgtacgtcgtcggactacgccgtaccgccgtccgtacgactaacgtccgtcgtcgggtcctaccgcggggtacggttacggggaacggtacggcttacgtagtttactttagttacgttcttacgtacttagttacggtcggtcggttacgtaggtaacggtcgggtaccggttaagggttcgggttaaccggggcggaacggggtacgtaaacgggtaccggtacggttaacccggtagtcccggtaacgacccgggtaagtcccgtacccgggttccccgtacggtacccg

SEQ ID NO: 168913 - DNA, 650 bp, Homo sapiens
  misc_feature: GYAE6OF02FQ0HL.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatggttaggtaattattaaccttttctccgtaggtaaccaaacaaccacccgaaggaccaaaccgaccccctaaactcatactaattactaggacggacgtaactcgacggccggcccgttacgacggggtacttcgtcgtactccgtacttctcgtcgtcctccgtactcgacgtccgagaccgaccgtccctaccagtaaccatccgtacgtggcctccgaggtcggtacggggacgaggtcgtagtattattcttagtcttgtactatacgtcggtcgtagtacgttacggtcggtacggtaaggggttccggtagggacggggtagggaaccgtaagggtaccggttaccgggtaccgtacggtaccggaccgacccggtaacggcccgttacccggtccccggtacggtacccg

SEQ ID NO: 168914 - DNA, 707 bp, Homo sapiens
  misc_feature: GYAE6OF02FWQ5L.49.82.H05.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactcgaaaccngcagtgatggttaggaattactaaccttttctcctagtaccaacaacacccaggacaaacgacccccaaactcatctatttacgtgacggccgatcgacggccggccctcgacggggtctcgtgacgtccgtcttctcgtcggtcctccgtacgtcgtcggcacgaccgaccggtccctcccgtagacctaatccgttcgtcgggtcctccggaggtccgggtacggggaaccggtagggtccttaggttaacgtttaacgtttacgttcgtcgtttacgttacgtaacgttacggtcgggtaccggttacggtaaggttacgggtacgggtaccgggttaaggggttccggggttacggggtacggggaacggggtaacgtaacggggttaccggtaacccggttaccggttaacggtaccgaaccggtacccggtaacgggtcccgtaccccgggtccccccggttacggttaaccccg

SEQ ID NO: 168915 - DNA, 703 bp, Homo sapiens
  misc_feature: GYAE6OF02IJ7RP.49.82.H05.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatccaccatctcctgcactacgaaaccngcagtgattggttagggaatttacttaacctttttctccgtacggtaaccaaacaaccaacccaggacaaaacgccccccaaactcactctatttataggacggaccgactcgaacgccggtacccctcggacgggttctcgtagacgttcgtccttcttcgtcggtcctccgtacgtctcggacacgccgacccggtccctcccgtacgaacctacgtcctaccggtcgggtcctaccgacgggtaccggtagggggtaaccgcgggtccttagttatttacgtttagttcgttacgttacgttacgtacgtacgttcggtaccggttagtaagttacgggtcgggtaccgggttaaggggtcgggttacggggaccgggaacggggtaacccgaagggttaccggtacccggttaccggtacggtaccggacgaccccggaaggtccccgtaccggtcccccggttacggtcccg

SEQ ID NO: 168916 - DNA, 699 bp, Homo sapiens
  misc_feature: GYAE6OF02JSQP0.49.82.H05.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcacntctcctgcactgaaaccngcagtgatggtaggtaattacttacctttcncgtagtaccaacacaccgagacaaccgaccctaaactcatctatttacgacgacggtcactcgaacgtccgcccgtaggacgggtctcgtacgtacgtctaccttcgtcgtacgcctacgtacgtcgngtcncgaccgaccggtccctcgtacaactactccgtcgtcggtcctaccggaggtcggtacgggacgacggtcgttagtacgtttaagtcttcgtcgttcgttaagtacgtttacggtacgtccgggtaagtacggttaagggtaccgggtaacgggtttaaacgggttcccgggtaaccggggtaccggggtaaacgggtaccgaaagggggtttaccccgttaacccggttaccggttaaccgggtaaccgtaacccgggtcccggtaaaccgggttcccgtaccccgggtacccccggtttagggtaaccccc

SEQ ID NO: 168917 - DNA, 603 bp, Homo sapiens
  misc_feature: GYAE6OF02HM1KJ.49.82.H05.1.454.CMB.1.raw
  modified_base (430)..(430): a, c, t, g, unknown or other
  misc_feature (430)..(430): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataaccttttctcctggtaccaacaaccaccaggacaaacgcccccaaactcatcatttatgaggccgatcacggccgccctcgacgggttctctagactccgtcttctctcggcctacccgacgtctaggccagccgaccggtccctcccgtgaccacttctcgtcggctccgaggcgtggggaccgnggctagtatttattatgtcttagttcaagttgtcggtccggtagtagttagggtcgggtaccggtaagggttcggtcggggacgggtacgggtaccgtaagggtccggtaccggtaccgttacggtacgacggacccgaggtcccggtacccggtcccccgttacggtacccg

SEQ ID NO: 168918 - DNA, 866 bp, Homo sapiens
  misc_feature: GYAE6OF02HJ26X.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtcgtgggtcctcctaggacagtcgatcaccatctctcgcactacgaaaccagcagtgagttggttagggtaatttaacttaaacccttttccgtaccgttacggtaaaccaaaaccaaccaacccgaacgggaaccaaaaaccgtacccccctaaaactacctaacttacttaatttaacgtcggaacggaccgtaactaccgaacggccggtaccccgtacggtacggggtccttaccgtacgtacgtccgttaccgttccgtcgtcggtacccgtttacccgtaaccggtttccggttaccgggaccggtaaccgtaccccgggtaccccgggtaccctttaccccggtacgttaaacctaaaccgttccgttccgggttaccgggtacccgtaccggaccggggtacgggtacggggggaaccggtacggtaccggttacggttaacgttttaacgtttacgttacgtccgtttagttactaaccgttacggttacggtccgggtaacggttacgtacggggtacccggggtaacgggtaacggggttcgggttaccggggaccggggtaaccggggtaaccggtaacggggttacccggtaaccggttaccggtaacggttacccggaacgtaccccgggtacggtacccggttaccccggtccccccgggttagtaaccccgg

SEQ ID NO: 168919 - DNA, 796 bp, Homo sapiens
  misc_feature: GYAE6OF02GBA23.49.82.H05.1.454.CMB.1.raw
  modified_base (643)..(643): a, c, t, g, unknown or other
  misc_feature (643)..(643): n is a, c, g, or t
tcagagtcgagagacacgaccggtgctcgatttagtcgagctctctcgcggggggggtcacaagaggcagcgctctcgggacgtctccaccatgcctgggctctgctgctcctcactctcctcactcaggacacagggtcctgggcccagtctcgccctgacctcagcctgcctccgtgtcgtgggtctccgtgacagtcgatccacattcctcctgacctactacgaaaaccaggtcaaggtgtattggttagggaactttaactttaaaccttttctaccgttacggtaaccctaaaaccaacccgtaaccccgagggaaccaaaaccggtccccccccaaaaacttcccaaattaccctaattttaacgtacggaacggggtaccctaacgtaccgtacggacccgggtcccccttagggaaccgggggtttccttccgtacggtaacgttcccgtacctttccgttacggtccggtccttccccgtaaccggttcgttaccggaccgtacggacccggtcccggtcccttcccgtagaaccgtacttccgttcgggtcgggtaccttaccgagggtccgggtaccggggaagtacgggtccttaaggtactttaaagttcgttgttacgtttcgttaanagttagtccggtcggttagtagttacgggtcggacgggttaacgggtggttaccgggcggggaacgtaaggtaacgggtcccggaacgttccggtaaggtacccgtccggaacccgtaacgggcccttcccggtcccccggtacggttaaccc

SEQ ID NO: 168920 - DNA, 665 bp, Homo sapiens
  misc_feature: GYAE6OF02JXJ3M.49.82.H05.1.454.CMB.1.raw
  modified_base (301)..(301): a, c, t, g, unknown or other
  misc_feature (301)..(301): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgccactagaaaccagcagtgatgttaggaattattaacctttctctgtaccaacaacacctaggacaaacgccccaaactcatcatttangacggccatcgacgccgcctcgacgggtctctgtactcgtcttctcgtcggtcctccgtacgtcgtacggctacgccgtaccggtccctccgtacgacctaaacttccgttaccgtccgggtaccctaccggacgggtaccggtacgggggtaaccgacgggtccgttacggttaactttaagtttacgttacgtcctttcggttactacgttacgtcggttcggtaggttaacgtagggttacgggtaccgggttaaggggttcggtttaccgggacggggtaacggtaacggtaacgggtacggtaccgtacggttacgtcgacggacccgtaacgtccgtacccgcccgttccggtacccg

SEQ ID NO: 168921 - DNA, 183 bp, Homo sapiens
  misc_feature: GYAE6OF02IHG64.49.82.H05.1.454.CMB.1.raw
  modified_base (177)..(183): a, c, t, g, unknown or other
  misc_feature (177)..(183): n is a, c, g, or t
tcagagtcgagagacacgaccggtgctcgatttagtcgagctctctcgcgggctctctcgcgggcacgaccggtgctcgatttagtcacgcgagaaagggaaaggggctggccctgacgtgtttctgttcccaccctcctctctctcgactctgagcgggctggcaaggcgcatagnnnnnnn

SEQ ID NO: 168922 - DNA, 218 bp, Homo sapiens
  misc_feature: GYAE6OF02HMKNL.49.82.H05.1.454.CMB.1.raw
  modified_base (212)..(218): a, c, t, g, unknown or other
  misc_feature (212)..(218): n is a, c, g, or t
tcagagtcgagagacacgaccggtgctcgatttagtcgagctctctcgcgggcacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 168923 - DNA, 601 bp, Homo sapiens
  misc_feature: GYAE6OF02JA6IK.49.82.H05.1.454.CMB.1.raw
  modified_base (226)..(226): a, c, t, g, unknown or other
  misc_feature (226)..(226): n is a, c, g, or t
  modified_base (381)..(381): a, c, t, g, unknown or other
  misc_feature (381)..(381): n is a, c, g, or t
  modified_base (491)..(491): a, c, t, g, unknown or other
  misc_feature (491)..(491): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtcctccgtggacagtcgatcaccatctcctgccactgaaaccngcagtgagtgttaggaattacttaaccttttctcgtacgtaccaactaaccaccgaggaccaaaccgacccccaaactctatactattatcggacggccatcgacgccggcccgtcgacgggtctacgtgactcgtcttctgtcgctctacgtcncgtacactccgaccgccctcctagaactactcgtacgcggtcctcgaggcgtacggggacgtcgtcgttagtattacgttatcgtctgtactagtacgtgtcggttacgngtacggtcgggacgtgggttacggtcgggacgggaggtaccggtaggtaccggtaccgtacggtaccggtaccgaccgaccggtacgtccgtacccgtccccgcgttacg

SEQ ID NO: 168924 - DNA, 209 bp, Homo sapiens
  misc_feature: GYAE6OF02FLRS8.49.82.H05.1.454.CMB.1.raw
  modified_base (151)..(151): a, c, t, g, unknown or other
  misc_feature (151)..(151): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (201)..(209): a, c, t, g, unknown or other
  misc_feature (201)..(209): n is a, c, g, or t
tcagagtcgagagacacgaccggtgctcgatttagtcgagctctctcgcgggacgaccggtgctcgatttagtcgagctctctcgcgggcacgaccggtgctcgatttagtcacgcgagaaagggaaaggggctggccctgacgtgtttcngttcccaccctctctctctcgactctgagcgggntggcaaggcncatagnnnnnnnnn

SEQ ID NO: 168925 - DNA, 692 bp, Homo sapiens
  misc_feature: GYAE6OF02FYD0W.49.82.H05.1.454.CMB.1.raw
  modified_base (135)..(135): a, c, t, g, unknown or other
  misc_feature (135)..(135): n is a, c, g, or t
  modified_base (223)..(223): a, c, t, g, unknown or other
  misc_feature (223)..(223): n is a, c, g, or t
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacanagggtcctgggcccagtctgccctgactcagcctgcctcgtgtctgggtctcctggacagtcgatcaccatctcctgcactgaaaccngcagtgattggtggaattactaaccttttctcgtggtaaccaacaaccacccgaggacaaacgcccccaaactcatctaatttangtacggccatcagtccggccctcgagggttctacgtgacttccgnttcctctcggacctcgacgtctggcacgccacggccctcctgaaccatctacgtgggccttcgaggtcggtacggggacgtacggcttaggtattttaacgttagttcgtctttaggttactagttagttccgggtaccgtaggttaacgttgggttaccgggtaaaccgggttaacggggtttcggggtttaccccgggggagggggtaaaccggggtaaccccggtaaggggttacccggaacccgggtttttacccgaagggttacccgtaacccgggtaccccgtaaaccggggtccccgttacccccggttccccccggttcggttaacccccg

SEQ ID NO: 168926 - DNA, 845 bp, Homo sapiens
  misc_feature: GYAE6OF02IMADV.49.82.H05.1.454.CMB.1.raw
  modified_base (245)..(245): a, c, t, g, unknown or other
  misc_feature (245)..(245): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctcgcctccgtgtcgtcgggtctccgtggactaggtcgactccaaccattcctccgtgacctacgtacggaaaaccnggtcctaaggtcgtagtttaggggtttacggtaaacttttaactttaaacccgtttttcttacccggtttacgggttaacccaaaccgaaaccgaaccccgaacgggaacctaaaaccggacccccccgtaaaaacctctaacgttaaccttacgttttaacgtagggtaaccggtacccgtaacgttaccggaaccggtccccgggtacccccgttaccggttaacgggggttccccttacggtaacggtacgttccgtacgtttccgttccgtcggtaccttcccggaccgtttcgtacgggaccgacgcccgtaaccggtccccttacccgtagaacctaacgtttccgtcgtcggtacccgttggaacggtcgggtaccggagggtacgtacggtagtttaacgtttatttacgtttcgtcgtttacggttcttacgtagttaccgggtcggtacgttaggtaccgttacgggacggttaacggggttcggttaccggggagggaacggttaccggaacgggttaccgtacccggtaggtacccggtcgtaacccggttaacgcccggttccggcccggtccccgtacgttacccg

SEQ ID NO: 168927 - DNA, 884 bp, Homo sapiens
  misc_feature: GYAE6OF02F16I3.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctcgccctgactcagcctgcctcgtgtctgggtctcctggacagtcgatcaccatcctcctgcacgtacgaaaccagcagtagagttggttaggtaaattttaacttaaccttttccgtaccgtacggtaaccaaaaccaaaccgaaccccgaggaaccaaaacccgacccccctaaaacgttccaacttaaccgtaattttaacgacgggtaaccggtaccgtaacgttaccgaaccggtcccgggtaccccgttacgggtacgggtttcctaccgttacggtaacgtttccggttcctttccgttccggttccggtaccctttaccccggttaacggtccgttaccgggccgtaaccggtcccgaccccggttccctacccgtacgtaacccgtaacgtttcccgttcggtccgggttaccctaccggtacgggtcccggggtacgggggaccggtaaccgggttccggtttaagtaacgtttttaacgttccggtttcggtacgtttcggtttaacctaggttaccggttaccgggtaccggggttagtaacggggtttccggggtaccgggttaaaccgggggttacggggttaccgggtacccgggggtaaggggtaaaccggtaacgggtaaccggttaccggttaacccgggttaccggttaaccgggccctaaccgggcccggttaaacggtcccgtccccccggtacccggttacgttacccg

SEQ ID NO: 168928 - DNA, 210 bp, Homo sapiens
  misc_feature: GYAE6OF02F85RF.49.82.H05.1.454.CMB.1.raw
  modified_base (204)..(210): a, c, t, g, unknown or other
  misc_feature (204)..(210): n is a, c, g, or t
tcagagtcgagagacacgaccggtgctcgatttagtcgagctctctcgcgggcacgaccggtgctcgatttagtcgagctctctcgcgggcacgaccggtgctcgatttagtcacgcgagaaagggaaagggggctggccctgacgtgtttctgttcccaccctcctctctctcgactctgagcgggctggcaaggcgcatagnnnnnnn

SEQ ID NO: 168929 - DNA, 634 bp, Homo sapiens
  misc_feature: GYAE6OF02HO5WO.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcagggtctctgatcgcttctctcggctccacgtctggcagcacgcctccctgacaactctcgtgggcctccgaggccgtgggggacgaggctaggtaatttagtttaacttgtactcggtttacaagttaacgtcggtcccgggttagtaacgtttacgggttcgggaaccggtaaagggggtttcgttaccgggggcgggtaacgggggtaacccgaaggggttccggaacccggttcccggttaacgggtcccgaacgggtacccccgaaagggttccccgtacccggtacccccccgttagggttacccccg

SEQ ID NO: 168930 - DNA, 758 bp, Homo sapiens
  misc_feature: GYAE6OF02IEEVG.49.82.H05.1.454.CMB.1.raw
  modified_base (224)..(224): a, c, t, g, unknown or other
  misc_feature (224)..(224): n is a, c, g, or t
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtcgtggtctcctggacagtcgatcaccatctcctgcactacgaaacngcagtgatggttaggaatttacttaaccttttctccgtaggtaccaaacaaccaccgagacaacgccccaaactcactctatttangacgcactcagccgtccngtacgggtctcgtgactcgtccttgtcgtcggcctaccgtacgtcgtcggactacgccgtacccggtccctacccgtacgaaccgtaacgtttccgtccggttacgggaccctacccgggtaagggtccgggtacgggggaaccgggtaccggtacggtttaacgttaagttttaagtttacgtttcggtacgtttacgttaacgtacgttaccgggttcgggtaccgggttaaggttacgggttaacgggttaccggggtacgggtaaccgggggtttacggggttaccgggggtaacggggtaaacgggggtaaaccggtaaacggggttacccggttaacccgggttacccgttaacgggtacccgaccgggtaacccggaaccgggttccccgtaacccgggttccccccggttacggtaaccccg

SEQ ID NO: 168931 - DNA, 843 bp, Homo sapiens
  misc_feature: GYAE6OF02H98HD.49.82.H05.1.454.CMB.1.raw
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctggtctccgtggaccagtcgatcaccatctcctgccactacgaaaccagctagtgtagtggttagggtaaactttacttaacctttttcctcccttacgggttaacccaaaacctaaaccaaccccgagggaccaaaaccgtaccccccaaaacgttacaactctaagttttatacgggacggtaccgaagtaccacggccggtacccctacggtacggggttcctacgtcgtacgtccgtaccttccgttcgtccggtcctacccgtacggttcgtcggacgtaccgggtccaacccggggtcccctttaccccgtaggtaacctaaaccgtttacccgttaccgtccgggacccttcccggacgggttacgggtaccggggggtaaccggtagggttacctttagggttaacttttaacggttttaaccgttcggtttactttacggtttaccgtaagttaccggttacgggtccgggttaaggttacgttaaggggtttacccgggtaaccgggttaacgggggtttcgggttacggggggtaccgggtaacggggtaaccgtaacggggttaccgttaacccgggttaccggttaccggtacccgttaccgggaaccgtacggggttacccgtcccggtaccccccggttcggtaccccg

SEQ ID NO: 168932 - DNA, 682 bp, Homo sapiens
  misc_feature: GYAE6OF02F7XCF.49.82.H05.1.454.CMB.1.raw
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatcctcctgaccacgtcgaaaccngcagtgatggttaggaattacttaacctttctctagtaccaacaacaccaggacaaacgccccaaactcatctattanagacggcgatcacggccgccgtcgacgggtctcgtgactcgtcttccgtctggccttcccgacgttcgtcggccacggtcccgaaccggtccctacccgtacgaacccttaaccgttccgttaccgggtcgggtcccgttaccggtacggggtccgggttacgggggaccggtacggtacgttagggtaacttttagtttaaggttcgtacctttgtttaaaccagttacgtttccgggacgttaggacgttagggtccgggtacgggtaaggggttcggttaccggggacgggtacgggaccggtaagggtaccggtacccggttcgaacggttcgacgaccccggaggtcccctcccggccccgtaggtcccg

SEQ ID NO: 168933 - DNA, 312 bp, Homo sapiens
  misc_feature: GYAE6OF02H9BJ9.49.82.H05.1.454.CMB.1.raw
  modified_base (306)..(312): a, c, t, g, unknown or other
  misc_feature (306)..(312): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcgagtcacctacttcctcctcgaccactacggaaaaccagcagtgatggttagggtaatttacttacctttctcgtacgaaccaacacaccagacaaccacccaatcannnnnnn

SEQ ID NO: 168934 - DNA, 575 bp, Homo sapiens
  misc_feature: GYAE6OF02JFC4A.49.82.H05.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacngtcgatcaccatctcctgcactacgaaaccngcagtgatgtggtaattataacctttctctagtacaacacaccaggacaacacccaactcatcattangacgcgatcagccgcncgngggtctctgctcgtctcctgtcgcctccacgtctgcacggccaccggtcctcgtcaactactctcggtcggtactcgaggcgacggggacgtacggtcttagtattttagtacgttcgtacttggttactagttagtccgggtagttacgaaggtcggttcggacggtaagggttcgggtacggagggtaacggacggtacgggtccgtacgtccgtagtaccgcgaccggtaccgcccgtaccggtccccgtagtacccg

SEQ ID NO: 168935 - DNA, 154 bp, Homo sapiens
  misc_feature: GYAE6OF02HNOZ7.49.82.H05.1.454.CMB.1.raw
  modified_base (145)..(154): a, c, t, g, unknown or other
  misc_feature (145)..(154): n is a, c, g, or t
tcagagtcgagagacacgaccggtgctcgatttagtcgagctctctcgcgggcacgaccggtgctcgatttagtcgagctctctcgcgggcacgaccggtgctcgatttagtcgagctctctcgcgggctggcaaggcgcatagnnnnnnnnnn

SEQ ID NO: 168936 - DNA, 756 bp, Homo sapiens
  misc_feature: GYAE6OF02FGTB8.49.82.H05.1.454.CMB.1.raw
  modified_base (223)..(223): a, c, t, g, unknown or other
  misc_feature (223)..(223): n is a, c, g, or t
tcagagtcgagagacacgaccggtgctcgatttagtcgagctctctcgcgggggggtcacaagaggcagcgctctcgggacgtctccaccatggcctgggctctgcctgctcctcactctcctcactcaggacacagggtcctgggccagtctgccctgactcagcctgcctccgtgtctgggtctccgtggacagtcgatcaccatcctctgcactgaaccngcagtgactgttagggaattacttaacctttctcctaggtaccaacaaccacccgaggaccaaaccgcccctaaactcaactctaattatagtacgccgaatcgaacgccggtaccctcgtacgggtctcgtgtactccgtcttcctcgtcggcccgtaccacggttccgtacggcctaacggcccgtaacccgggtcccttacccgtacggtaaccctaacttcccgttacggtcccgggtacctacccgggtaggtaccgggttacgggggaaccgtaacgggtccgttaaggtaactttttaaacgtgttccggtctttacggtttacctaagtaaccggtttccgggaaccggttaggtaacgttacggggtccgggtaaaccgggttaggggttccggtttaccgggggacgggaaccgggtaacggtaaccggggttacggtaaccccggttccggttaacgggttccccgaacggtaccccggaaccgggttccctccccggttaccccggttcccttaacccggg

SEQ ID NO: 168937 - DNA, 746 bp, Homo sapiens
  misc_feature: GYAE6OF02GJD94.49.82.H05.1.454.CMB.1.raw
  modified_base (477)..(477): a, c, t, g, unknown or other
  misc_feature (477)..(477): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacaggtcctgggcccagtctgccctgactcagcctgcctccgtgtctgggtctccgtggacagtcgatcaccatcctcctgcactagaaaccagcagtgagtgtaggtaattataacctttctcctgtaaccaacaaccaccagacaaacgacccccaaactcatacctattacgtgacggaccatacgacgccggccctggtacgggtcttcgtagtactcgtcttctcgtcgcctaccgacgttcgtcggacacgaccgtaccggtccctacccgtacgacctaacgtccgtccgtcgggtccctaccggacgggaccggttagggggaaccggtacgggtnttaacggtaacttttaaggttttacgttacgttccgtttagtttacctagttaacggttccggtacgggttagaacggtttacgggtcggggtaaccgggttaacggggttcggttaccgggggaccggggtaaccggggtaacgggtaaaccgggggttccgggttaaccccgggttaccggttaaccgggggttaacccaaccgggtacccccgggtaaacggttacccccgggtcccggttcccccccggttacggttacccccgg

SEQ ID NO: 168938 - DNA, 741 bp, Homo sapiens
  misc_feature: GYAE6OF02FZXNL.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactgaaaccngcagtgatgttaggaattatactttctctgtacaacaacaccagcaacgaccccaactcactctattatgaggccatcacgccgcctcgacgggtctctgactcgtcttcctcgtcggtcctccgtacgtcgtcggcacgccgtaccggtccctacccgtagtaacctaacttcccgttcgtaccggggtccttacccggtacgggtccgggtacgggggtaaccgggtacgggtaccgttacggtaacgttttagtttaacgtttcgtaccgttttcggtttacctaagttacgttacgggtaccgggttaggtaacggttaccgggttcggggtaacccgggttaacgggggttcgggtttacccgggggacggggtaaccggggtaacccgggttaaacggggttacccgggttaacccgggttacccgggttaacgggttacccggtacccggtaacccggtaaaccggggtccccggtaccccggttcccccggttaccgggttacccccg

SEQ ID NO: 168939 - DNA, 145 bp, Homo sapiens
  misc_feature: GYAE6OF02I4V7F.49.82.H05.1.454.CMB.1.raw
  modified_base (136)..(136): a, c, t, g, unknown or other
  misc_feature (136)..(136): n is a, c, g, or t
  modified_base (141)..(145): a, c, t, g, unknown or other
  misc_feature (141)..(145): n is a, c, g, or t
tcagagtcgagagacacgaccggtgctcgatttagtcgagctctctcgcgggcacgaccggtgctcgatttagcgagctctctcgcggcacgaccggtgctcgatttagcgagctctcaggcgggctggcaaggcncatgnnnnn

SEQ ID NO: 168940 - DNA, 777 bp, Homo sapiens
  misc_feature: GYAE6OF02IJ6Z7.49.82.H05.1.454.CMB.1.raw
  modified_base (353)..(353): a, c, t, g, unknown or other
  misc_feature (353)..(353): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctggggcccagtctcgccctgactcagcctcgccctccgtgtcgtcgggtctccgtggacagtcgactccaccatccgtcctagacctactacgaaaccgtcgcagtagattggttaggtaacttacttaaccttttcgtccgtacggtaaccaactaaccacccgaaggaccaaaaccgtacccccaaactacagtaccttaatttacgnggacggccgtaatccgacggcccggtacccgttacgggtacgggttccgtgtacggtactccgttcttacgtcgtcggtccttaccgtcgttccgtcggacgtcggaccgtacccggtccttacccgtagtaaccttacgtccgtcgggtaccgggtccttaccggacgggtacgggtaacgggggacgggtacgttcgttaacgggtttaacgttagttttaccggttcgtaccgtttgttacgtaaacgtttccggacggggttaccgggtaagttacgggttaccgggtacgggggtaccggttacggggggttccgtaccgggggacgggtaccgggtaaccggtacgggttacccgtccggttacggaacggtcctaacgggaccggtacgtcccggtcccgtacccggtcgtacccgg

SEQ ID NO: 168941 - DNA, 586 bp, Homo sapiens
  misc_feature: GYAE6OF02GNW0N.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctctggtaccaacaacaccaggcaaagccccaaactcatcatttatgaggccgatcagccgccctcgaggggtctctgatcgcttctctggcctccacgtctgcagcacgcctcctgacaactctacgtggctccgaggtcgtaggggacgaggtcttagatttattagttcgtcttgttctattacgtcggtcggttagtagttacggtcgggaccggtaaggggttcgttaccgggacgggtaacgggaaccggtaagggtacggtaccggttaccgttagggtccgacggtccccgtaagggtcccgttacggtcccccgtggttacccgg

SEQ ID NO: 168942 - DNA, 774 bp, Homo sapiens
  misc_feature: GYAE6OF02I9OE0.49.82.H05.1.454.CMB.1.raw
  modified_base (341)..(341): a, c, t, g, unknown or other
  misc_feature (341)..(341): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatcctccgtgccacgtacgaaacctagcagtgagttggttaggtaactttaacgttaacctttttctccgtacggttaaccaaaccaaacctacccgacggaccaaaccgacccccaaactcaactctaatttagngacggcatacgacgccggccctacgtacgggtctcgtcgactcgtcttctcgtcggtcctacgacgtcgtacggcacgccgtaccgacccttccacgacctaaacttccgtaccgtggtcccgtccggacgggtacgggtacggggtaaccggagttacgttaacggtttaatttacgttacgttaacgttcgttacgttacttaacgttccggtacgggttaccggttagtaaccgggttaaccggggtacggggttaaccggggttaacgggtttccggggttaacggggtaccggggtaaacgggtaaaacgggtaaccgggtttaaccggtaacccgggttaaccggttaaccgggtaccgtacccgggtaacccgttaacccgggtacccggttaccccccgttcccgggttaaccccgttacccccg

SEQ ID NO: 168943 - DNA, 686 bp, Homo sapiens
  misc_feature: GYAE6OF02HSBXG.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactagaaaccngactagtgattggttaggaattacttaacctttttctccttaggtaccaactaacacccaagacaaacgcccccaaactcactctaactttagtgacggccgatacctaggccggccctcgaggggtcctcgtagactcgacttctacgtcggtcctcctacggtcctaggtccaggccgaccgccctacccgtcgaaccacttcctcgtcgggcctccgaggtcggtggggacgtacgggctagttaactttagtttattcgtcgttcgttactacgttatcgggtaccgtaggtacgtttcggtgggtaccggtaaggggttcgggttaccggggcgggtaacgggggtaacccggtaaggggtacccggtaacccgggttccggttacgggtaaccgttaccgggaaccccggtaacgggttcccgttaccccggtaccccggttccgggttaaccccg

SEQ ID NO: 168944 - DNA, 563 bp, Homo sapiens
  misc_feature: GYAE6OF02F35WJ.49.82.H05.1.454.CMB.1.raw
  modified_base (224)..(224): a, c, t, g, unknown or other
  misc_feature (224)..(224): n is a, c, g, or t
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (445)..(445): a, c, t, g, unknown or other
  misc_feature (445)..(445): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctctgtaccaacaacaccagacaaacgccccaaatcatcattangacgcgatcagccgcctcgagggtctcgtgactcgtcttctcgtcggctccacgtntggcagcaccggcctcctgacaatctcgtggctccgagtcgtggggacgcggcgttgattattattgtacttgttactagttacgtcgtccggtnaagttggtacgaccgggttaagggtggttccgggacgggtaacggaccgaagggtccgaacccggttccgtaggtaccgacggtacccgaaggtcctacccggtccccctcggtaacc

SEQ ID NO: 168945 - DNA, 179 bp, Homo sapiens
  misc_feature: GYAE6OF02FF16P.49.82.H05.1.454.CMB.1.raw
  modified_base (170)..(179): a, c, t, g, unknown or other
  misc_feature (170)..(179): n is a, c, g, or t
tcagagtcgagagacacgaccggtgctcgatttagtcgagctctctcgcgggcacgaccggtgctcgatttagtcgagctctctcgcggcacgaccggtgctcgatttagacgtcttcatcttcccgccatctgatctctcgactctgagcggctggcaaggcgcatagnnnnnnnnnn

SEQ ID NO: 168946 - DNA, 171 bp, Homo sapiens
  misc_feature: GYAE6OF02JKID1.49.82.H05.1.454.CMB.1.raw
  modified_base (139)..(139): a, c, t, g, unknown or other
  misc_feature (139)..(139): n is a, c, g, or t
  modified_base (159)..(159): a, c, t, g, unknown or other
  misc_feature (159)..(159): n is a, c, g, or t
  modified_base (165)..(171): a, c, t, g, unknown or other
  misc_feature (165)..(171): n is a, c, g, or t
tcagagtcgagagacacgaccggtgctcgatttagtcgagctctctcgcgggcacgaccggtgctcgatttagtcacgcgagaaagggaaggggctggccctgacgtgtttctgttcccaccctcctctctctcgactntgagccggctggacaaggcncatagnnnnnnn

SEQ ID NO: 168947 - DNA, 690 bp, Homo sapiens
  misc_feature: GYAE6OF02I0RYO.49.82.H05.1.454.CMB.1.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (357)..(357): a, c, t, g, unknown or other
  misc_feature (357)..(357): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctgccctgactcagcctgcctcgtgtctgggtctcgtgacagtcgatcacctatctcctgactactagaaaccngctagtgagttcggttaggtaacttacttaacctttcncgtacgtaaccaacgacacccaggacaaacgcccctaaatcagtctatttgacggacggctatcgacggccgccctaggcgggtctcagtcnccgtctacgtcgtcggtcctcgtgtccgtgaccgagcccgaccgtccctacgtagaacctacgttcgtccggtacggtcctaccggtacggtcgggtacgggacgtacgtacgttagtaactttagttacgttcgtcgtttagttagtacgttacgtccggtaggttacgtacggttaccggtaacgggtccggggttaaacgggttccgggttacggggaacgggtaccgggaaccgggtaacgggttccgggtacccggttaacggtacccggtaaccgtaccggacccggtaaccggttcccgtacccggtaccccgttacggtacccgg

SEQ ID NO: 168948 - DNA, 738 bp, Homo sapiens
  misc_feature: GYAE6OF02JQMJG.49.82.H05.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacgagggtcctgggcccagtctcgccctgactcagcctgcctcgtgtcttgggtctccgtggtacngtgctcgacctntctctgcctacgtgaaaaccngcacggttntaagttggttaggtaaaactttattaaccttttaccttccgttacggttaaaccctaacaaccgtaaccccgaagggaacctaaaaaccggccccccctaaaacctaacctaactcctaacgtttttaacgacggtaccggacccgtactacgtaacgtccggacccgtacgtacggggtactccgtagacgtctccgtcctctcggccttcgacgttcgtacgtccacggccaccggccttcctaacgacgttaactacccgttcgttccggaccggttccgacgggtcgacgggggacacggttacgtcgttaagtttacttacgttgtacttgttacgtacgttagttcggtaccggtacgtaaggttcggtacgggaccggttaagggttcgttacggggacgtaagggtacggtaaacgggttcgaacccgggttcgtacgaccgtacggtaacccggacgtacccggttcccgaccccggttggtaaccccg

SEQ ID NO: 168949 - DNA, 229 bp, Homo sapiens
  misc_feature: GYAE6OF02FX7IQ.49.82.H05.1.454.CMB.1.raw
  modified_base (213)..(229): a, c, t, g, unknown or other
  misc_feature (213)..(229): n is a, c, g, or t
tcagagtcgagagacacgaccggtgctcgatttagtcgagctctctcgcgggcacgaccggtgctcgatttagagagagtgtggttgggtttgggggaagaggaagactgacggtccccccaggagttcaggtgctgggcacagcggccctgggctgcctggtcaaggactacttcctctctcgactctgagcgggctggcaaggcgcatagnnnnnnnnnnnnnnnnn

SEQ ID NO: 168950 - DNA, 699 bp, Homo sapiens
  misc_feature: GYAE6OF02GPK7M.49.82.H05.1.454.CMB.1.raw
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccagcagtgattggttagggtaattacttaaccttttctcctggtaaccaacaacacccaggacaaacgccccaaactcatctattatgacggccgatcacggccggccctcgacgggtctcgtgactcgtcttctcgtcggcctccgacgtcgtcggcacgcgaccggccctccgtacgaacctaactccgtccgtcgggtcctaccggtacgggccggtagggggaccggacggtccttagtaagtttactttaacgtttcggtctttaggttactagttacgttcggtacccgggttaggtacggttacgggttacgggtaccgggtaagggggtttcgggttccggggaccggggtaacggggtaccgggtaaacgggttccgggtacccggttaccggttaacgggtaccggtaccggtaccggtaaaccgggtcccggtacccgggtaccccccggttcgggtaaccccg

SEQ ID NO: 168951 - DNA, 796 bp, Homo sapiens
  misc_feature: GYAE6OF02HBPQU.49.82.H05.1.454.CMB.1.raw
  modified_base (227)..(227): a, c, t, g, unknown or other
  misc_feature (227)..(227): n is a, c, g, or t
  modified_base (312)..(312): a, c, t, g, unknown or other
  misc_feature (312)..(312): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctccgtggacagtcgatcaccatctctgcactagaaaccngcagtgagtgttaggaattacttaaccttttctcgtacgtaaccaacaccaccgaggaccaaacgaccccaaatcatctattagngacggcgatcgacggccgccgtcgtacgggttctacgtagtacgtcccgttacttccgtcgtcggtaccctacccggtacggttccgtacggccgacgtacccgtacccggtcccttacccgttacggaacctaacgtttcccgtaccgggttcgggtaccctaccggtaccgggtccgggggttacggggaccggtacggttacggttaacgtttaacgttttaaacgtttctttcgggttacgttttcgttaacgtaagtttaccgggttaccgggttaccggtaacgggtttaacggttaggggttaacccgggggttaccggggttaagggggtttaccggggttaccggggtaacgggggtaacggggtaaaacggttaacggggtaccgggttacccggtacggttaacgggttacccgaacgggtaccccggtaacgggtccccgtacccccgggttacccggtccggttaaccccg

SEQ ID NO: 168952 - DNA, 755 bp, Homo sapiens
  misc_feature: GYAE6OF02JL1DJ.49.82.H05.1.454.CMB.1.raw
tcagagtcgagagacacgaccggtgctcgatttagtcgagctctctcgcggggggggtcgacaagaggcagcgctctcgggacgtctccaccatggcctgggctctgctgctcctcactctcctcactcaggacacagggtcctgggcccagtctcgccctgactcagcctgcctcgtgtctgggtctccgtggaccagtcgatccaccattcctcctgaccactacggaaaaccctagacagtctaagttggttacgggtaaatttaagttaaccttttccttacccgttacggttaaccaaacctaaaccaccccgtaacggacaaaaccgacccccctaaaaccgtaccctaacgtacctaatttaactagaacggtaccgaactacgaaccggccggtaccccgtacgaacggggttcctaccgtacgacgtccgttcgttccgtttaccgtggtcccttacgtacccgttcgtcggtaccgtcgaccgaccccggtccctacccgtacggaccctaacttacccgttccgggtacgggtcccttccggaacgggtcgggttaccggggaacggtaccggtgttacgtagtttacttacgttagtcgtttgtaacctgttaacgtccgggtacgtggtacgtacgggttacggacgggttaacggtcggttacgggtacgggaaggaacggtaggtacgtacccggtcgtaacggcgtacgccggtacgtccgtccgcccggttgtacccg

SEQ ID NO: 168953 - DNA, 639 bp, Homo sapiens
  misc_feature: GYAE6OF02GAUCH.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatcctcctgcactgaaaccagcagtgatgttgggaattataaccttttctctggtaccaacaacaccaggacaaacgcccccaaactcatctatttatgacggccgatcacgccggccctcgacggggtctctgactcgcttctctcggtcctccacgtctcggcgacgtcaccggccctccctcgactaatctcgtcggtcctcgacgggtcgtggggacgaggtcttagtactttattaacgttgtctttggttacctaagttacgtcgggtaccggttgtacgttaggggtcgggtaccgggtaaggggttcgggttacgggaggggtaacgggtaacgtaacggggtaccggttacccggttaccgttaggggttaccaaccgggtcccggaacgggtcccgttaccggtccccccgttacggttaacccg

SEQ ID NO: 168954 - DNA, 843 bp, Homo sapiens
  misc_feature: GYAE6OF02HQ9T6.49.82.H05.1.454.CMB.1.raw
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgacctccgtgtcgtcgggtcctccgtaggacctaggtcgactccacccatcctccgttgaccgtaccgtacgaaaccgagaccgtaggtagtacgttgggttacgggttaaacttaactttaacccgtttccgttaccgtacggtaaacccaaaccaaccgaacccgaacggaaacctaacccgtaaccccctaaactactaacttacttaacgttacgtacggacggtaccgtacgtaccgaccggtccggtacccggtacggtacggttcgtacgtacgtacgtcgtaccttaccgtcgtcgtcctacccgtacggtccggtacggaccgaccgcccggtacccgtaccctacccgtacgtaaccttaccgttccggttcccggtaccgggtcccgttaccgggacgggtaccgggggtacggggtaacggtacggttacgttaacgttaagtttaacgtttaccgttcgttaccgttacggttaacgttacgttacggtaccggtgtaagtacgggtacggggttacggtacgggttaaggggttacggggtacgggaacggggttaacggtaacgggtaaccggtacccggttaccggtacggttaaccggacccggtaaccggtaccggtaccggtcccggttaccccggtacccggttcgtacccgg

SEQ ID NO: 168955 - DNA, 626 bp, Homo sapiens
  misc_feature: GYAE6OF02GRJB5.49.82.H05.1.454.CMB.1.raw
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagcagtgatgttagggaattattaccttttctctgtaccaacaacaccagacaacgacccctaacncatctattntgacgccgatcacgcggtcccgtcgagggtctgtcgatcgtcttctcgtcgctccacgtctcgacagccacgtccctccgtgactacgtcctcgtcggcctccgaggtccggtggggaccgaggtcgtagtacttatttattcgtcttgttacagttacgtcggtaccgggtagtaagttacgggtacgggtacccggtaagggggttcggttaccgggggtccgggaacgggtaccgggtaaaggtaccgggttacccgtaccggttagtacccggaacggtaccccggtaaccggtccgtcccggttccccgtaccggttacccg

SEQ ID NO: 168956 - DNA, 636 bp, Homo sapiens
  misc_feature: GYAE6OF02GZHJZ.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccngcagtgatggttaggaatttacttaaccttttctcctggtaaccaacaacaccaggaccaaacgcccccaaactcaactctaatttagagacggccatcgacgccgccctcgagggtctcgtgactcgtcttctcgtcgtcctaccgacgtccgtggacctagccgacccggtccctacccgtagaacactcgttaccgcggtacctccgaagggtcggtacggggacgtcgtcgttattacgtttattacgtgttcgttattcgtatacgtcgtcggtagtagtacgtcgggtacgtaagggttccgtacgggaccggtacgggtaaccggtaggtaccggaccggttacgttacggtccgaaccggtccgaacggttcccggtacccggtcccccggtacggtaccccg

SEQ ID NO: 168957 - DNA, 766 bp, Homo sapiens
  misc_feature: GYAE6OF02GID7J.49.82.H05.1.454.CMB.1.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (418)..(418): a, c, t, g, unknown or other
  misc_feature (418)..(418): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctggcccagtctgccctgactcagcctcgcctccgtgtctgggtctcctggacagtcgatcaccntctcctgcactagaaaccngctagtgattggtaggtaattacttaaccttttcctacctggtacccaactaaccacccgaggacctaaaccgacccccaaactctaactcctatttacaggacggcccgaatcgacgccggtacccctcggtacgggtaccttcgtacgtaccgtcgtccttcgtcgtcggtacctccgtacgtcgtcgacncgtaccgacccgtccctcccgacgtacctaacgtccgttaccggtccgggtcctcccggtaacgggtcccgggtacgggggtaacccggtaacgggtccggttacgtttaacttttacgtttacgtttaacgttcggttttaccgttacgtaacgtttaggtcccggtaaccggggttaacgttaggttaacgggtacggggtaccgggtttaaggggttccgggtacggggtaccggggtacgggaaccggtaacggggttaccggtaacccggttaccgttaacgggtacccgaccggaccccggtaaaggttccccgtacccggtccccggttacggttccccgg

SEQ ID NO: 168958 - DNA, 891 bp, Homo sapiens
  misc_feature: GYAE6OF02I3AK6.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccatcctctgcacgtacgaaaccagccagtgagttacggttagggaattaacttaaccttttccttccgttacggtaacccaacaaaccacccgacggaacctaaaccgacccccaaacgtacaattactagtttactacgacggtaccgtacttaccgacgcccggtcccgtccgtaggggttcctacggtacgtacgttccgtaccctttccgtccgttccggtacccttacgtaccggttccgtacgggtaccgtacggacccggtaccccggtccccgtttaccccgtacgaaccccgttaaaccggttcccgttacggttcccgggtaccctaccgggtaacgggtccggggttaacgggggaaccggtaccgggttacgttaacggtttaaacgttttaacttttaaccgggtttacgttccgtttacggttaaccttagttaaccgttaccggggttacccgggtaggtaacggtttaaccggggttaccggggtaacccggggtttaaacgggggtttcgggtttaaccgggggtaaccgggggtaacggggttaaaccgggtaaacgggggttacccggggtaacccgggtttaccggttacgggttaacccggtaaccggaacccgggttaccggtaccccggtttaccccgggtacccccgggttaccggttaccccg

SEQ ID NO: 168959 - DNA, 669 bp, Homo sapiens
  misc_feature: GYAE6OF02J1BWJ.49.82.H05.1.454.CMB.1.raw
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
  modified_base (515)..(515): a, c, t, g, unknown or other
  misc_feature (515)..(515): n is a, c, g, or t
  modified_base (572)..(572): a, c, t, g, unknown or other
  misc_feature (572)..(572): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctcgccctgacctcagcctgcctccgtgtctgggtcctcgtggactaggtcgatccacatcctcctgccgtactagaaaccgagcgtagtgtagttggttaggtaatttacttaacccttttcnccgtacggtaccaacacctacccnggtaccaaaccgtaccccctaatcatcctaatttgnggacggtccctancgaccgcgtaccctggtacgggtctcgtgtactccgtcttaccncgtccgacctccgtacgtgtcggcgtaacgcccgacccggtcccgtcctaggtaccaacgttcgtccgtacggtcctacggtcggtcgggtacgggacgtacgcgtatttacgttagtcgtntcgtatcgtatacgtcggtacgtgtaagtcggacggtaccgagggttcgtaccgggnggtaacgggaacgtaacgggtaccggtaccggttaccgtagggtaccctacggtacccggtacggtcccggtaccccggttcccgttaccgtacccg

SEQ ID NO: 168960 - DNA, 900 bp, Homo sapiens
  misc_feature: GYAE6OF02I1K8Z.49.82.H05.1.454.CMB.1.raw
tcagagtcgagagacacgaccggtgctcgatttagtcgagctctctcgcgggggggggtcacaagaggcagcgctctcgggacgtctccaccatggcctgggctctgctcgctcctacactctcctacactacgacggacacgtacgggtccgtcgggacctagttctcgcctagcctacgacgcctcgtccgtcgtcgttcgtcggtcctcgtcgactacgtcgactaccaccgtacttccgtcctacgacctaacgtaaaccgaaaaccgcgacgtaggtacgtaggtttacgggtttaaggttaaacttttaaccttttaaccgttttccgtaccgttaaccggtaaacccaaaaccaaacccgaaccgtaacggaaacccaaacccgtaacccctaaacttactaaccttacttaagtttacggagggtaccggtacctaacgacgaccgggtccggtacccggtacgggtcgggttctacggtcgtaccgttcttcgttaccgttcggtccgtaaccgttccggtacggttcggacgggtaccgacggacccggtaccgttcccctaccgtaacgtaaccttacgttccggttaccgggtcccggttaccgtcggggacggtaccgggggtaacggggtacggtaccggttagttacttttaaagtttacgtttaccggttcgtttcttaacggtttcgttaaacgttggggttaccgaggggtttaacgtcggtaacgggtacggggttaaccggttaggggtttacggggaccgggtacggggtaaacggttaacgggtaacgggttccggttaacccgggtaagtttaacgggacccgaaccggggtaaccgtcccgggtacccggtaccccgtccggggttacctaaccgg

SEQ ID NO: 168961 - DNA, 179 bp, Homo sapiens
  misc_feature: GYAE6OF02JFDAZ.49.82.H05.1.454.CMB.1.raw
  modified_base (165)..(179): a, c, t, g, unknown or other
  misc_feature (165)..(179): n is a, c, g, or t
tcagagtcgagagacacgaccggtgctcgatttagtcgagctctctcgcggcacgaccggtgctcgatttagtcacgcgagaaagggaaagggggctggccctgacgtgtttctgttcccgccctcctctctctcgactctgagcgggctggcaaggcgcatagnnnnnnnnnnnnnnn

SEQ ID NO: 168962 - DNA, 664 bp, Homo sapiens
  misc_feature: GYAE6OF02GU227.49.82.H05.1.454.CMB.1.raw
  modified_base (213)..(214): a, c, t, g, unknown or other
  misc_feature (213)..(214): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (653)..(653): a, c, t, g, unknown or other
  misc_feature (653)..(653): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacgagggtcctgggcccagtctcgccctgactcagcctgcctccgtgtcgtggtcctccgtgacagtcgatcacatctcnncactagaaccngctagtgtagtgttaggtaattacttacctttcncctagtaccaactaccaccgagaccaaaccgccccaactcatactattagngacgctacncgacgccgtccctggacggtctacgtcgtactccgttactcgtcgtcgaccgttcccgacgttcggtcgacgacgtcccggaccgtccctaccgtagacctacgttcgtacggtcgccgtaccggcgggttcggacgggtacgtacgtggttaatttacgtttacgtttgttacgttcgttagttactaccgtggtttaccggtcggttataagggttcggtaacgggttggtaacggggttccggtaagggtacgggaacggttaacgggtaacggtaccgttaccggtaacggccgtaccgacggtaccgtccggtcccgacccgttcccgngttaaccccgg

SEQ ID NO: 168963 - DNA, 260 bp, Homo sapiens
  misc_feature: GYAE6OF02FYGWB.49.82.H05.1.454.CMB.1.raw
  modified_base (250)..(260): a, c, t, g, unknown or other
  misc_feature (250)..(260): n is a, c, g, or t
tcagagtcgagagacacgaccggtgctcgatttagtcgagctctctcgcgggcacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacgttcctctctcgactctgagcgggctggcaaggcgcatagnnnnnnnnnnn

SEQ ID NO: 168964 - DNA, 661 bp, Homo sapiens
  misc_feature: GYAE6OF02IMMDY.49.82.H05.1.454.CMB.1.raw
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
  modified_base (476)..(476): a, c, t, g, unknown or other
  misc_feature (476)..(476): n is a, c, g, or t
  modified_base (528)..(528): a, c, t, g, unknown or other
  misc_feature (528)..(528): n is a, c, g, or t
  modified_base (544)..(544): a, c, t, g, unknown or other
  misc_feature (544)..(544): n is a, c, g, or t
tcagagtcgagagacacgaccggtgctcgatttagtcgagctctctcgcgggcacgaccggtgctcgatttagtagtcgcataaagggaaagggggtgggtccaggaggcagaactcgtgggtgtctcaccatggcctggactccctctacttcctccccctcctcactctctgcacaggctcgtgacggccctcctatgacgctcgacacgacgcccacccgtcggtgtcgagtccgtaccccgaggacacggaccggaccagggacctcgacctgcctcgtaggganagtcgactagttacgaccctaaacgnttaacgtgtactttaagttccggaacagacgaacgaaccggcccggacctaccgggtccccgttggttggttggtagtaatacggtaaaagtaaggaccctagtagggaacggtacggaccccgttaggacggtaccttccggtagtacgacgttacttcncggtcggactcgacgggtacgaacggacgttaacggcgaactgtacgactcncgtagcgtacgcaggngacgaggacgcgtacgagttacttagttatacgttaaaacctagacaactaccgtacgtagtttcgtacgttagtaccttacggtacgacgttaccgacgttaccgacggttacccg

SEQ ID NO: 168965 - DNA, 323 bp, Homo sapiens
  misc_feature: GYAE6OF02FVO6K.49.82.H05.1.454.CMB.1.raw
  modified_base (259)..(260): a, c, t, g, unknown or other
  misc_feature (259)..(260): n is a, c, g, or t
  modified_base (262)..(323): a, c, t, g, unknown or other
  misc_feature (262)..(323): n is a, c, g, or t
tcagagtcgagagacacgaccggtgctcgatttagtcgagctctctcgcgggcacgaccggtgctcgatttagagagagtgtgttggggtttggggggaagaggaagactgacggtcccccccaggagttcaggtgcgtggcacgacggccggcccggtggctcgtccgttggtacgaacggtaccttaccttccctcctccgtccgtacctcgtaggacgggccgggtcgcggaacgaacgggccgacctaaggtagnncnnnnnnnnnnnnnnnnnnnnnnnnnnnnnnnnnnnnnnnnnnnnnnnnnnnnnnnnnnnnnn

SEQ ID NO: 168966 - DNA, 264 bp, Homo sapiens
  misc_feature: GYAE6OF02HV3MR.49.82.H05.1.454.CMB.1.raw
  modified_base (217)..(217): a, c, t, g, unknown or other
  misc_feature (217)..(217): n is a, c, g, or t
  modified_base (250)..(264): a, c, t, g, unknown or other
  misc_feature (250)..(264): n is a, c, g, or t
tcagagtcgagagacacgaccggtgctcgatttagtcgagctctctcgcgggcacgaccggtgctcgatttagtcgagctctctcggggcacgaccggtgctcgatttagagagagtgtgttgggtttggggggaagaggaagactgacggtccccccaggagttcaggtgctgggcacagcggccctgggctgcctggtcaaaggactacttcctntctcgactctgagcggctggcaaggcgcatagnnnnnnnnnnnnnnn

SEQ ID NO: 168967 - DNA, 198 bp, Homo sapiens
  misc_feature: GYAE6OF02GG2MD.49.82.H05.1.454.CMB.1.raw
  modified_base (175)..(175): a, c, t, g, unknown or other
  misc_feature (175)..(175): n is a, c, g, or t
  modified_base (181)..(198): a, c, t, g, unknown or other
  misc_feature (181)..(198): n is a, c, g, or t
tcagagtcgagagacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagcgagctctcgagcgggctggcaggcncatagnnnnnnnnnnnnnnnnnn

SEQ ID NO: 168968 - DNA, 307 bp, Homo sapiens
  misc_feature: GYAE6OF02J072S.49.82.H05.1.454.CMB.1.raw
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (282)..(307): a, c, t, g, unknown or other
  misc_feature (282)..(307): n is a, c, g, or t
tcagagtcgagagacacgaccggtgctcgatttagtcgagctctctcgcgggcacgaccggtgctcgatttagtcgagctctctcgcggcacgaccggtgctcgatttagctctacgctcagggcagaccggtgctcgatttagagagagtgtgttgggttgggggagaggaagactgacggtcccccaggagttcaaggtgctggcacagcggcctgggctgcctggtcaaggactactcctntcncactctagnggccggctggacagggccanaagtgnnnnnnnnnnnnnnnnnnnnnnnnnn

SEQ ID NO: 168969 - DNA, 654 bp, Homo sapiens
  misc_feature: GYAE6OF02HPNWP.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactgaaaccngcagtgatgttaggaattataaccttttctcctgtaccaacacaccagacaacgcccccaaatcatctatttatgaggccatcgagccggccctgacgggttctgtgatccgtcttctctcggctacccgacgttccgtgcaacgccaccggtcccttacccgacgtaactaacgtccgtcgtagggtccctaccgacggtaccgggtcggggaaccgaggtacttagtacgtttagtttaacgttcgcgtttacgttactagttacttcggaccgggttagtaacgttagggtccgggaccgggtaaggggtttcgttaccggggtacgggtaagggtaaccggtaaacgggtcggtaacccggttccggtaacggtacgtacccgacccggtaacggtccccgtacccggtccccgttccggtacccg

SEQ ID NO: 168970 - DNA, 234 bp, Homo sapiens
  misc_feature: GYAE6OF02FQ2NO.49.82.H05.1.454.CMB.1.raw
  modified_base (212)..(234): a, c, t, g, unknown or other
  misc_feature (212)..(234): n is a, c, g, or t
tcagagtcgagagacacgaccggtgctcgatttagtcgagctctctcgcgggcacgaccggtgctcgatttagagagagtgtgttgggtttggggggaagaggaagactgacggtccccccaggagttcaggtgctgggcacagcggccctgggctgcctggtcaaggactacttcctctctcgactctgagcggctggcaaggcgcatagnnnnnnnnnnnnnnnnnnnnnnn

SEQ ID NO: 168971 - DNA, 679 bp, Homo sapiens
  misc_feature: GYAE6OF02H95YR.49.82.H05.1.454.CMB.1.raw
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (443)..(443): a, c, t, g, unknown or other
  misc_feature (443)..(443): n is a, c, g, or t
  modified_base (516)..(516): a, c, t, g, unknown or other
  misc_feature (516)..(516): n is a, c, g, or t
tcagagtcgagagacacgaccggtgctcgatttagtcgagctctctcgcgggggggggtcacaagaggcagcgctctcgggacgtctccaccatggcctgggctctggctgcctcctcactctcctcactcaggacacgagggtcctgggcccagtctcgaccctgactcgacgtccctgccctccgtgtcgtgggtcctccgtggactagtcgatcactatctctgcactacgaaaccngctagtgatggttagtaattacttacctttcncgtacgtacaacaccacgacggacaaccgaccctaactcactctattacggagacgccgtatctacggccgtaccgtacggtacgggtctacgtacgtaccttaccggtcttttaccgccgtgaccccttcgtacgtcgtcgtacacgacccgtacccggtcctacccganaacctacgttcgtcggtccggtcctaccggcggacggtcgggaagcgtccgttaagtaccttagtcgtacgtntacgttcgacgttcgacgggttcgtaggtacggtgtaccgggggtacgttcggggtacggttcgggaccggaagggacccggttaaggtaccggttcccgtaggtttaccgggaccgtaccggaacccggtcggtaccccctcggtacccccggtaggttccc

SEQ ID NO: 168972 - DNA, 677 bp, Homo sapiens
  misc_feature: GYAE6OF02F3SGS.49.82.H05.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
tcagagtcgagagacacgaccggtgctcgatttagtcgagctctctcgcgggggggtcacaagaggcagcgctctcgggacgtctccgaccatggcctgggctctgctgctcctcactctcctcactccaggacacagggtcctgggcccagtctgccctgactcagcctgcctcgtgtctgggtctcctggacagtcgatcaccatcctctgcactgaaaccngcagtgatgtaggatatactttcnctgtacacacnccagcaacgccccaatcatcattatgacgcatcagcgcctgacgggtctcngtactcgtcttctctggcctccgtacgtcgtacggcacgtaccgaccggtccctacctcggtaactaacgtcctacggtcggtccttaccggacggtcgggtaccggggtacggacggtaccgttagtaacgtttacgtttaacgttcgtcgtacgtttacgtacgttaacgtccggtacccggttagtacggtttacgtacggggtaccggttaacggggttacgggttacccggggtacggggtaaccggtaaccgggttaaaacgggttcccggtaacccgggtttaccggtaacgggtaccggtaaccggtcccgggtaaccggtacccggtcccggtaacccccggttccggttaaccccgg

SEQ ID NO: 168973 - DNA, 110 bp, Homo sapiens; identical to SEQ ID NO: 168864
  misc_feature: GYAE6OF02G5IFC.49.82.H05.1.454.CMB.1.raw
  modified_base (107)..(110): a, c, t, g, unknown or other
  misc_feature (107)..(110): n is a, c, g, or t

SEQ ID NO: 168974 - DNA, 564 bp, Homo sapiens
  misc_feature: GYAE6OF02FSXIQ.49.82.H05.1.454.CMB.1.raw
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
tcagagtcgagagacacgaccggtgctcgatttagtcgagctctctcgcggggggggtcacaagaggcagcgctctcgggacgtcctccaccatggcctgggctctgctgctcctcactctcctcactcaggacacagggtcctgggcccagtctgccctgactcagcctgcctccgtgtctgggtctctggacagtcgatcaccatcctctgcactgaaaccngcagtgatgttaggaattataccttttctcctgtaccaacaacaccaggcaacgcccccaaatcatcatttatgacgccgatcagccgccctcgagggtcntgactcgcttctctgctccacgtntcggcngcaccggtcctccctgaccctctcgtcgggtccgtccgggctacgaagtagtggacggtcttgtatttnttctagctgccttactagttacngtaccgagtacacgtactaacgttaagttttcgtagtacgttaggtttccggacggtacgggaacgtaagtccgtaccgtaccggttaccgtaggtacctacggacccgtaaccggg

SEQ ID NO: 168975 - DNA, 701 bp, Homo sapiens
  misc_feature: GYAE6OF02FF3O9.49.82.H05.1.454.CMB.1.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (340)..(340): a, c, t, g, unknown or other
  misc_feature (340)..(340): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtcctgccctgactcagcctgcctcgtgtctgggtctccgtggacagtcgatcaccntcgtccngcactagaaaccngcaggtnacgtagttggaattactaacctttctcctacggtacaacctaaccaccaggaccaacgacccccaatcatctattatcgagtcgatcacgtcgacctcgagggtctncgtactcggtcttccgtctcggtcctacccgtacgtcgtacggctaacgcccgtaccggtccctccgtacgactacgtctcggcgggtccttcggacgtcgggtcgggacgtcggtacgttaggattttaaggttacttcggtcgttcgtttaccgtagtacgtcggtaccgggttagtaaccgttacggcggtaaaccgggtaggtacggtttacgggacccgggtaacgggggaaccgggttaaacccgggtaacgggttacccgggtaaccccggttaccggttaacccggggtaccgtaaccgggtccccccggtaaagggtcccccgttaccccgggtacccccgtttaacccggg

SEQ ID NO: 168976 - DNA, 1098 bp, Homo sapiens
  misc_feature: GYAE6OF02H8R3R.49.82.H05.1.454.CMB.1.raw
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgccttccgtgtcgtgggtcctccgtggacgagtcgatcaacctactctcctgctacgtaggaaaaccagacagtgagtacgttagggaaatttattaaaccttttactccgtacggtaaccaaactaaccgaacccgtaacggaccaaaaccgaccccctaaaacctacaacttactaatttacgtaggacgtaccgatacgacgtccggtacctacggtagggtcctacgtacgtactacgtcgttttacgtaccgtcggtacctacccgtaacggttaccggtcggtaccgtaacgggtacccgtaacccgggtaccccgttttaccccgtacgggtaaaccttaaaaccgtttccccgtttaccgggttaccggggtaaccccgttacccgggtaaacgggggttacccggggttaaccggggggggtaaccgggggttaaacggggttacccggtttaaagggttttaaacgtttttaaaaccggtttttaaacgggttttacgggtttacccggttttaaaccggttttaacgggttaaaaccggttttaaaccggggttacccggggtttaaccggggtttaacgggttaaaccgggggttttaaaacggggttacccggggggtaaaacccgggggggtttaaaccggggggttttacgggggggttttaacccgggggggaaacccgggggggttaaaacgggggggtttaaaaaacccgggggtaaaacgggggtttaaaacccgggggtttaacccccggggtttaaaacccgggtttaaaccggggggtttaaaccccgttaaaccccgggggggtaacccccgggttaaaaccggggggttaacccccccggttttaccccggggtttaacccccccccccgggggtttaccgggtttttaaaacccccccggggg

SEQ ID NO: 168977 - DNA, 267 bp, Homo sapiens
  misc_feature: GYAE6OF02F2KXN.49.82.H05.1.454.CMB.1.raw
  modified_base (249)..(267): a, c, t, g, unknown or other
  misc_feature (249)..(267): n is a, c, g, or t
tcagagtcgagagacacgaccggtgctcgatttagtcgagctctctcgcgggcacgaccggtgctcgatttagtcgagctctctcgcggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnnnnnnnnnnnnn

SEQ ID NO: 168978 - DNA, 229 bp, Homo sapiens
  misc_feature: GYAE6OF02JGEX0.49.82.H05.1.454.CMB.1.raw
  modified_base (206)..(206): a, c, t, g, unknown or other
  misc_feature (206)..(206): n is a, c, g, or t
  modified_base (212)..(229): a, c, t, g, unknown or other
  misc_feature (212)..(229): n is a, c, g, or t
tcagagtcgagagacacgaccggtgctcgatttagtcgagctctctcgcgggcacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcncatagnnnnnnnnnnnnnnnnnn

SEQ ID NO: 168979 - DNA, 748 bp, Homo sapiens
  misc_feature: GYAE6OF02JWZX5.49.82.H05.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctcgggcccagtctcgccctgactcagcctcgcctccgtgtcgtgggtcctccgtggacagtcgactccaccacttcctcctcgccacgtacgaaaccngactagtgtagttggtagggtaattattaacctttacctccgtacgtaccaaccaacaccgagacgaaccgacccctaactcactactattacgtagacggcgtatacgacggaccgtccgtacggtcggtcgtagtcgtcgtcgtcttctcgtcgtccgtccgtacgtcgtcgaccgtacgaccgtaccgtccctccgtacgtacctaacgtccgttccggtccggtaccgtaccggtacgggaccgggttcgggacggtacggtcgttacgttaatttacgttagtttcggtacttacgttacttaggttacggtaccgggtaccgttaggttacggttacgggttaccgggtaccgggttaaggggtttcgggtaccggggaggggtaacgggtaccggggtaaccgggttaccggtaacccgggttcgttaacgggtacccggtaaccggtcccggggtaaaccgtccccggtacccggtttcccccggtaccgggttacccgg

SEQ ID NO: 168980 - DNA, 783 bp, Homo sapiens
  misc_feature: GYAE6OF02G9UP2.49.82.H05.1.454.CMB.1.raw
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctcgccctgactcagcctgcctcgtgtctgggtctcctggacagtcgatccaccntctcctgacactagaaaccngcagtgtaagtggttaggtaatttacgttaaccttttctccgtaggtaacctaaccaaccacccgtaggacctaaacgaccccctaaagtccacgtactattttaacgacggtacggaccgtattacgacggtcccgtacccgtacggtacgggtacctcgtacgacgttccgtccgttaccttcgtaccggtaccttacccgtaaccggttcgtacggtaccgacggtacccgaccggtccccgtttacccgtaacgtaacctaactttcccgtacggttacccgggtaccttacccggaagggtcccgggttaagggggaccggtacgtacggttacggtaattttacgttacgttcgtaccgtttacgttaactacgttaaccggtaccggtacggttagtacggttacggtcgggtaccggttaaggggttccggttaacgggacggggtaccggtaacgggttaacgggtacccggttaaccgggttccaaccggggttccgaaccggttacccgggtacggacccgtttcccggaccccggtgttaacccg

SEQ ID NO: 168981 - DNA, 672 bp, Homo sapiens
  misc_feature: GYAE6OF02JJGJL.49.82.H05.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgcctgactcagcctgcctccgtgtctgggtctctggacagtcgatcacatcncctgcatagaaaccngctagtgtattggtaggaattactaaccttttctcctgtaacaacaacaccaggacaaacgaccccaaactcatactattangagcgatcagaccgtcctacgaggggttctcgtagtacgtccgtcgttcncgttcggaccttacgtaccgttcgtacgcaacggcctacccggtcctaccgtacgtaactaacgtcctacgtcggacctaccgaggcggttacggggacgtacggtcttagtaagtttagttaacgttcgtcgttcgttacgtaattaggtacggtaccggtaggtaacgtttacggcggggtaaaccgggtagggttacgggttaccggggcgggttaaccgggaacggtaaccggggttaaccgaaccgggtttaccggtaaccgggtacgacggttaacccggaggtaccgttacccggtccccgttcggtacccg

SEQ ID NO: 168982 - DNA, 171 bp, Homo sapiens
  misc_feature: GYAE6OF02JFYW2.49.82.H05.1.454.CMB.1.raw
  modified_base (165)..(171): a, c, t, g, unknown or other
  misc_feature (165)..(171): n is a, c, g, or t
tcagagtcgagagacacgaccggtgctcgatttagtcgagctctctcgcgggcacgaccggtgctcgatttagtcacgcgagaaagggaagggggctggccctgacgtgtttctgttcccaccctcctctctctcgactctgagcgggctggcaaggcgcatagnnnnnnn

SEQ ID NO: 168983 - DNA, 112 bp, Homo sapiens
  misc_feature: GYAE6OF02IVRE2.49.82.H05.1.454.CMB.1.raw
  modified_base (107)..(112): a, c, t, g, unknown or other
  misc_feature (107)..(112): n is a, c, g, or t
tcagagtcgagagacacgaccggtgctcgatttagtcgagctctctcgcgggcacgaccggtgctcgatttagtcgagctctctcgcgggctggcaaggcgcatagnnnnnn

SEQ ID NO: 168984 - DNA, 612 bp, Homo sapiens
  misc_feature: GYAE6OF02FJPFK.49.82.H05.1.454.CMB.1.raw
  modified_base (298)..(298): a, c, t, g, unknown or other
  misc_feature (298)..(298): n is a, c, g, or t
  modified_base (592)..(592): a, c, t, g, unknown or other
  misc_feature (592)..(592): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatcctctgcactcgaaaccagcagtgatggttggaattataacctttctctggtaccaacaacaccagcaaacgcccccaatcatcatttangagccgatcacgcgcccgtacgacgggtctctgactcgcttctcgtggcctaccgacgtcgtcggcacgtccgaccggtccctcccgtgacctaatccgtcgtcgggcctccgacgggtcgtggggacggacggtcgtacgtagttttagttacgttgtcgttagttactaacttagtcggtaccggttagagttagggcggtaccggtaggggttcggttcgggacgggtacgggacccgtaagggtccgtacccggtccgttacggtaccgtaccggtaccgaacggttccnccggtacccccttggtaccc

SEQ ID NO: 168985 - DNA, 719 bp, Homo sapiens
  misc_feature: GYAE6OF02FKAR9.49.82.H05.1.454.CMB.1.raw
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (570)..(570): a, c, t, g, unknown or other
  misc_feature (570)..(570): n is a, c, g, or t
tcagagtcgagagacacgaccggtgctcgatttagtcgagctctctcgcgggggggggtcacaagaggcagcgctctcgggacgtctccaccatggcctgggctctgctgcctctcactctcctcactcaggacacagggtcctgggcccagtctgccctgactcagcctgcctcgtgtctggtcttccgngactagtcgatcaaccattccctcctagcctaactcgaaaaccngcgaagttcgagtttaggtaggttaaactttaatttaaacccgttttcctccgttacggtaacctaaacctaaaccgaacccgaacggaaccaaaaacccggtaccccccaaaacgtcctaattaccctaaagtttaacgtacggaacggaacccgtagttaccgaccggcccggtcccgtacggtacggggtctcggtacgtacgtcgtctttcgtcgttccggccctttacggacgttaccgcgggtacacggacccggtacccgtccctaccgaacgtaactaacgttaccgtccggtaggtccctccgtacggaccgggttcgggtaacgnggtcttagttaagtttcgttacgttacgtattcggtacttaatcgtacggcgttagtacgttagggtcggtacggtagtgggttacggcgggacgagaccggtactcggtcgtacgcggacctccgaacggtccgccgtccgtcgtacg

SEQ ID NO: 168986 - DNA, 723 bp, Homo sapiens
  misc_feature: GYAE6OF02IMX05.49.82.H05.1.454.CMB.1.raw
  modified_base (230)..(230): a, c, t, g, unknown or other
  misc_feature (230)..(230): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatccaccatcctcctgcactacgaaaccngcagtgagttggttaggtaatttacttaaccttttctccgtacgtaaccaactaacaacccgaggaccaaaccgaccccaaactctatctattagacggagaccgatcgacgaccggccctacggacgggttctcgtacgtactcgttacttcctcggggggtcctacgtcccgtacgttcgtacggacgacggcccgtaccggtaccccgtccgtacgtaacctaccgttaccgtccgggttaccgggtccctacccgggtacgggtaccggggtcggggaacggtacgggtcgttaacggtttaactttaacgtttagttcgttcgtttaccgttacgtacgttacggtcggttaccggtagttacggtacgtacgggtacggttaacgggtcggttcgggacgggtacggtacggtaacggtaccggtacccggtacgtacggtacgtccggaaccgtcggtacccgtccgtaccccggtacggtacccg

SEQ ID NO: 168987 - DNA, 106 bp, Homo sapiens
  misc_feature: GYAE6OF02HQLA8.49.82.H05.1.454.CMB.1.raw
tcagagtcgagagacacgaccggtgctcgatttagtcgagctctctcgcgggcacgaccggtgctcgatttagtcgggctctcgagcgggctggcaaggcgcatag

SEQ ID NO: 168988 - DNA, 678 bp, Homo sapiens
  misc_feature: GYAE6OF02JUJM0.49.82.H05.1.454.CMB.1.raw
  modified_base (169)..(169): a, c, t, g, unknown or other
  misc_feature (169)..(169): n is a, c, g, or t
  modified_base (255)..(255): a, c, t, g, unknown or other
  misc_feature (255)..(255): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactacaggacacgagggtcctcgggcccagtctcgccctgactcncgccgtgccctccgtgtcgtggggttcctccgtggtacgagttccgaatcacctatcctcctgaccactacgaaaccagctagtgnttaggttaggtaattacgttaccttttctcgtacgtaccaacaacctaccgacgaccaaccaaccccaatactactactattacgagacggctaancgcgccgcctacgcgggtctacgngacgtctcttctcgtcgtacctccgtacgttcgcgtacgcgaccgtacccggtcctacccgtagaacttacgtccgtcggtacggccgtacggtagggtccggtacggggaggtctacggttagttaacgtttaacgtattccgtgtcgttaacgttgtacgtcgggtattcggagttacggtcggggttaacgtacgggtacggtacggggagtacgggaacgggttacgaccggttacggtcccgtaagggtaccgacgttacgggtacccgtaccgtccccgaccggttccgtaacccgg

SEQ ID NO: 168989 - DNA, 729 bp, Homo sapiens
  misc_feature: GYAE6OF02HC355.49.82.H05.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
tcagagtcgagagacacgaccggtgctcgatttagtcgagctctctcgcggggggggtcacaagaggcagcgctctcgggacgtctccaccatggcctgggctctgctgctcctcaccctcctcactcagggcacaggggtcctgggcccagtctgccctgactcagccgccctccgcgtccgggtctcctggacngtctgtccaccatctcctgcactggaaccagcagtgtacggtttggtgaattaataactatgtctcgtggtaaccaacacgtacccgaggaccaaacgcccccagactnaatgtaatttagtggcggtactaaggtaacggccggtccctacggtacgggtccctaggtacgtcgttccttcgtcgtacggtcctaccgtaacggttcgtacggaacgaacccaccggtccctaccgtacgtacccgttcgtccggtcgggtcccgttcgggaccgtaggaacggtagtacgggtacgggtcgttaaggttacttttacgtttccgtacgtccgtagtccttacgtagttagtccggaccgtaaggaccgtaagtaaccttaaagtttaagtttggtaagttaacgtttggttacccggggagggtaacccggtacggtaacggttccgtaaccgggttaccccgttacgggtaaccggtaccggtaaccggaacccgtaacccgggcccgttacccccggttaacccccggg

SEQ ID NO: 168990 - DNA, 747 bp, Homo sapiens
  misc_feature: GYAE6OF02GU2W8.49.82.H05.1.454.CMB.1.raw
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggacagtcgatcacatctcctgcactagaaaccagcagtgagtggttaggtaattacttaaccttttctccgtacggtaaccaaacaaccaaccgacggaccaaacgaccccctaaactactaactacgtaatttagtacggacggaccgagtccacggtccggtcccgtcgacggggttctacgtcgtacgtccgtcttcctcgtcgtcctaccgtacgtcgtcgacgacgccgaccggtccctacccgtagaacctacgttcctccggtcggtacccgtaccggacgggtccgggtacgggggtaacggtacggtacggttacgtttaagttttaagttacgtttcgtacgtttacgtttactagttacgttcgggtaccgggttaaggtacgtttaagggtaccggggtaccgggtttaaggggtccggggttacggggacggggttacgggaaccgggttaacgggtaccggtaacccgggttccgttaacgggtccgtaacccggaccggtacgggtaccgttaccccgggtacccccggtcggttaccccg

SEQ ID NO: 168991 - DNA, 734 bp, Homo sapiens
  misc_feature: GYAE6OF02FK7HP.49.82.H05.1.454.CMB.1.raw
  modified_base (241)..(241): a, c, t, g, unknown or other
  misc_feature (241)..(241): n is a, c, g, or t
tcagagtcgagagacacgaccggtgctcgatttagtcgagctctctcgcgggggggggtcacaagaggcagcgctctcggggacgtctccaccatggcctgggctctgctgctcctcactctcctcactcaggacacgagggtcctgggcccagtctgccctgactcacgcctgcctccgtgtcgtggtctccgtggacgagtcgatcaccatcctctcgcacgtacgaaaccagctagtntagttgggttacggtaatttaactttaaaccttttccttccttacggtaaccaaaccgaaccaaccccgaacggtaaccgaaacccgtaaccccccctaaactacctaattccttaatttacgtacggtaacggaccgtacgtaccgacggtacccggcccgttacggacggggttcctcgtagtaccttcggttaccttccgttccgtaccgccgtttacccgaccggtcgtacggcgtacggcccgtacccggtccctcccgtacaaccttacgtccgtcggttccggtcctccggagggacgggtcgggaccgtgtcgttagtactttagttcgttagtctttcgtaacttgtacgtcgggtacgtatacggttagggtcgggaaaggtagggttacgggtcggacggggtcggtaaccgtcggaccggttacgcggttacggccgacggtacccggtaccggtccgtccccggtaccgtcccgttaccg

SEQ ID NO: 168992 - DNA, 148 bp, Homo sapiens
  misc_feature: GYAE6OF02ITBXT.49.82.H05.1.454.CMB.1.raw
  modified_base (121)..(121): a, c, t, g, unknown or other
  misc_feature (121)..(121): n is a, c, g, or t
  modified_base (144)..(148): a, c, t, g, unknown or other
  misc_feature (144)..(148): n is a, c, g, or t
tcagagtcgagagacacgaccggtgctcgatttagtcgagctctctcgcgggcacgaccggtgctcgatttagtcgagctctctcgcggcacgaccggtgctcgattttagcgagctctcncgcgggctggcaaggcgcatagnnnnn

SEQ ID NO: 168993 - DNA, 640 bp, Homo sapiens
  misc_feature: GYAE6OF02I4TQX.49.82.H05.1.454.CMB.1.raw
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctcctggtaccaacaacacccaggacaaacgcccccaaactcatcatttatgagcgatcagccgaccctcgacgggtctcgtcgtagtccgtcttcttcctgtcctccgaaccgttcgtcggcacgccgtacggccctcccngacctaactctcgtacggctccgcggtcggtcggggacgaggtccgtagtatttaagtnttagtcttggttacctagttacgtccgggtccggttagagttacggtcgggtaaccggttaacggggtcgggtttacggggacgggtacggggaaacggtaacgggtacggtaacccggttaccggtacggtacgtaccggacccggtaaagggcccgtaccggtaccccccggttcggttaaccccg

SEQ ID NO: 168994 - DNA, 667 bp, Homo sapiens
  misc_feature: GYAE6OF02HH7OF.49.82.H05.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
tcagagtcgagagacacgaccggtgctcgatttagtcgagctctctcgcggggggggtcacaagaggcagcgctcgtcgggacgtctccaccatggcctgggctctgctgctcctcactctcctcactcaggacacgaggtcctgggcccagtctgccctgactcagcctgccctccgtgtcgtgggtctccgtggacngtcgatcaccgatctcctgccactcgaaaccncgcagtgacgtggttaggtaaacttacttaaccctttctaccgtacggtaccaaacctaaccacccgaggtaacaaaccgacccccaaactccaatcctaagtttagtacgacgtccgtactcgacgccgtccgtacgtacggtctcgtgtacgtcgtcttcgtcgtcgtcctacccgtacggtctggactacgcccgtccggtccctccgtataacctaacgttcccgtcggttcggccctaccgtacgggtcggtacgggaccggtagtacgttacgttagttacgttacgtgtaccttgttacgacgttacggtcgtacggtagtacgtacgggtacggaccggttagggtcgttccgggaggaccggacgtacggtaccgtccggtacgcggtacgaccggcccgaggtcccgaccggtcccgacgttaccg

SEQ ID NO: 168995 - DNA, 762 bp, Homo sapiens
  misc_feature: GYAE6OF02GGQFL.49.82.H05.1.454.CMB.1.raw
  modified_base (227)..(227): a, c, t, g, unknown or other
  misc_feature (227)..(227): n is a, c, g, or t
  modified_base (317)..(317): a, c, t, g, unknown or other
  misc_feature (317)..(317): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctcgccctgactcagcctgcctccgtgtcgtggtctccgtgacagtcgatcacatctcctgcactacgaaaccngcagtgtatggttaggtaattacttaaccttttctcctaggtaaccaaaccaaccaccaggacaaccgaccccaaatcactactatttanagacggcatcgacggccgtaccctcggtacgggtctacgtacgtctacgtccttcgttacgtcggtacctcccgtacggttcctacggggactaccggtacccggtacccggtccccgttaccgtaccgaaacccgttaacgttcccgttacgggttccgggtacccgtacccgggacggggtaccgggtacggggggtaacccgtacgggtaccgttaggtttaaacttttaagtttacgttaccggtcttttacggttaacttacgttaacggttccggtaccgggttagttaacggttacgggtacggtaaccggggttacggggttacgggtcgggtacggggaacgggtaaaccggtcgggttaaccggtaccgttccggaaggtacccgacggtacccggtaaccgggtcccgtaccccggtaccccgtggttaccccg

SEQ ID NO: 168996 - DNA, 148 bp, Homo sapiens
  misc_feature: GYAE6OF02HS2YQ.49.82.H05.1.454.CMB.1.raw
  modified_base (145)..(148): a, c, t, g, unknown or other
  misc_feature (145)..(148): n is a, c, g, or t
tcagagtcgagagacacgaccggtgctcgatttagtcgagctctctcgcgggcacgaccggtgctcgatttagtcgagctctctcgcgggcacgaccggtgctcgatttagtcgagctctctcgcgggctggcaaggcgcatagnnnn

SEQ ID NO: 168997 - DNA, 757 bp, Homo sapiens
  misc_feature: GYAE6OF02FSLWC.49.82.H05.1.454.CMB.1.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
tcagagtcgagagacacgaccggtgctcgatttagtcgagctctctcgcggggggggtcacaagaggcagcgctctcgggacgtctccacatggcctggctctgctgctcctcactctcctcactcaggacacgagggtcctggggacccagtctcgccctgacctcagcctgccctccggtgtccgttgggtcctccgtggaccaggtcgatcaccntcctctgcactgaaacccngcagtgactgttaggaattatacctttctctcggtacaaccacaccgagacaaacgccccctaaactaccaatactatttacgtagacggtccgatactacggccgtacccctcgtacggggttcttcgtacgacttccgacttccgttactcgtacctcccggtaccgttcgtcggacctacggacccgtacccggcccttacccgacgtaacctaagttccttaccggtcggtccgttacccgaaggggtcccgttaccgggggacggtacgggtacccttaggtagttttaacgttttaacgttcggttccgtaggtttaactaacgtagttccgggaccgggtttagtaacggtttagggtcggtaaaccgggttacggggtaccgggtttaccggggacgggtaaccggggtaaccgaccgggtttaaccggttaaccccggttaccccggttaacgggttacgaaccggttccccaaagggttccccgtcccggtacccggtttcccggtaccc

SEQ ID NO: 168998 - DNA, 218 bp, Homo sapiens
  misc_feature: GYAE6OF02F9JCU.49.82.H05.1.454.CMB.1.raw
  modified_base (205)..(205): a, c, t, g, unknown or other
  misc_feature (205)..(205): n is a, c, g, or t
  modified_base (211)..(218): a, c, t, g, unknown or other
  misc_feature (211)..(218): n is a, c, g, or t
tcagagtcgagagacacgaccggtgctcgatttagtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcncatagnnnnnnnn

SEQ ID NO: 168999 - DNA, 735 bp, Homo sapiens
  misc_feature: GYAE6OF02IMBVD.49.82.H05.1.454.CMB.1.raw
  modified_base (240)..(240): a, c, t, g, unknown or other
  misc_feature (240)..(240): n is a, c, g, or t
  modified_base (376)..(376): a, c, t, g, unknown or other
  misc_feature (376)..(376): n is a, c, g, or t
tcagagtcgagagacacgaccggtgctcgatttagtcgagctctctcgcgggggggggtcacaagaggcagcgctctcgggacgtctccaccatggcctgggctctgctgcctcctcactctcctcactcaggacacagggtcctcgggcccagtctcgccctgactcagcctgcctcgtgtcgtcggtctccgtggacaggtcgataccacctactcctccctgaccactacgaaaccngacagtgagtggttaggaatttacttaacctttctcgtacggtaaccaacaaccaccgacgacaaaccgtaccccaaactctactactatttacgcgacgaccgtaatccgacgtccggcccgtaggtacggttcncgtagtacgtctcgttcgtcgtcggtacctcgtacgtacggtcgacgtacgtccgaccggtccccttcgtacgaacctactttccgaccggtcgaccgtaccggacgggtcgggacggggacgtacggtacgttaagttaagttttacgttagtcggtcttagttaccgtagttcggttacggtacgttaaggtaccggttacgttacggggtacggttaacgggggttcggtaccggggtacggaacgggggtaaccgtaaggggtacccggttacccggtaacggtaccggtacccggtacgggtaccccggtaaccgggttcccgtacccccggtccccggttaccggtaccccgg

SEQ ID NO: 169000 - DNA, 693 bp, Homo sapiens
  misc_feature: GYAE6OF02IC9XZ.49.82.H05.1.454.CMB.1.raw
tcagagtcgagagacacgaccggtgctcgatttagtcgagctctctcgcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggactagtcgatcaccatctcctgcctactacgaaaccagcagtcgtatggttagggtaatttattaaccttttctaccgtggtaacccaacaaccacccgaggaccaaaccgaccccctaaactcactactaatttagcgacggtaccatcgacggccggaccctcgtacgggtctcgtagtactcgtccttctcgtcgtcctccgacgtcgtcggcacgtacccgaccggtccctcccgtagtaacctaactccgttacggtcgggtcccgtccggtacgggtccgggtacggggccggtaacgggcgttagttaatttagtttacgttacggttccttaaggttactagttacggttcgccggttagtacgttagggtccgggtagggtacggggttcggttacgggacggggtaacgggtaaccgaagggttccggaccggttacgtacggtccgtacggacccgtacggtacccggtccgcccccggttagtacccg

SEQ ID NO: 169001 - DNA, 633 bp, Homo sapiens
  misc_feature: GYAE6OF02FSLK3.49.82.H05.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatggttaggaattataaccttttctcctggtaccaacaacaccaggacaaacgcccccaaactcatcatttatgagccgatcagcggccctcgagggtctctgactcgcttctctcggcctcctacgtcgtggacagccgaccgtccctcccgtagtaaccaatcctcgtcgggtccctccgagggtcggacggggacgaggtcgttagtatttaattagttcgtcgttgttacgtattaagtcggtaccggttggtaacttaggggtcggaccgggtaaggggttcgggtacgggtacgggaacgggtaacggtaaagggttccgggacccggttaccgtagggttacccacgggtacccgtaaacgggtcccgtacccgtcccccggttacggttaccccg

SEQ ID NO: 169002 - DNA, 678 bp, Homo sapiens
  misc_feature: GYAE6OF02G0UGA.49.82.H05.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctcgccctgactcagcctgcctccgtgtctgggtctccgtggacagtcgatcaccatcctcctgccactgaaaccngcagtgagttggttaggtaattacttaaccttttctccgttacggtaacccaactaaccgaccccgaggaccaaacgaccccccaaactctactactatttagcggtaacggccgtatcgacggtccggtccctacggtcgggtactcgtagtacttccgtcttcgtcgtcggcctaccgacgtcgtacggcacgccgaccggtcctccgtagactacttcgtacgtcggcctccgagggtcggtcggggacgtcggtacttagttactttagttagtcgtacgttcttacgtagttacgtcggtacggtaggtacgttacggggtcggtaccgggtaagggttccgggtacggggacgggtaacgggtaccggtaacgggtccggtaccgttacggtacggtcccgaacggtcccggtaggtccccgtcccggtccccggtagttcccg

SEQ ID NO: 169003 - DNA, 703 bp, Homo sapiens
  misc_feature: GYAE6OF02JTXOK.49.82.H05.1.454.CMB.1.raw
  modified_base (202)..(202): a, c, t, g, unknown or other
  misc_feature (202)..(202): n is a, c, g, or t
  modified_base (230)..(231): a, c, t, g, unknown or other
  misc_feature (230)..(231): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (533)..(533): a, c, t, g, unknown or other
  misc_feature (533)..(533): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacagggtcctggcccagtctgccctgacctcagcctgcctccgtgctgggtctcctaggacagtcgatcnccatcctcctagcactgaaaccgcagtnntagtcggaattactactttcncctcgacaacacaccngacaacgaccccaacttcactcactttaacgagtaccgactcgacgtccgccctacgagggtcctcgtactacgtcgtccgtttcctcttcggtccttaaccgcgttccgtacggtacaacgccggttaacccggccctttaaccacggtaaccaacgtttcctaccgggttcggtcctaaccgtacgggtccggtaacggggtaaccggtggtacccggttagttaacgtttgtttaaactcgtacttgttaaccgtagttacncggtaccggtagtaacggttggtaccgggtaacggttaacgggttcggggttacgacggggtaaccgtaacccggaaggggttccgtaccggtttacccgggtaaggtacccgttacccggaccccggtaaacggtcctaccccggttacccccggttcggttaaccccg

SEQ ID NO: 169004 - DNA, 231 bp, Homo sapiens
  misc_feature: GYAE6OF02H8Y43.49.82.H05.1.454.CMB.1.raw
  modified_base (213)..(231): a, c, t, g, unknown or other
  misc_feature (213)..(231): n is a, c, g, or t
tcagagtcgagagacacgaccggtgctcgatttagtcgagctctctcgcgggcacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnnnnnnnnnnnnnnnnn

SEQ ID NO: 169005 - DNA, 804 bp, Homo sapiens
  misc_feature: GYAE6OF02IQ6AI.49.82.H05.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctacactcaggacacgacgggtccagggcccagtctcgccctgactcgagcctcgaccttcgtgtcgtcgggttacctccgtggaactacggtacgactcaccgtntccgtcctgaccactacgaaaccngacagtcgtagtcggttagtacttacttacctttctaccgtacgtaaccaacaccgaccgaagacctaaaccgtacccctaacgtactactacgttatttacgacggacggtaacctagtaccggcggtaccgacccgttacgggtacggttactacggtacgtacgttccgttccttaaccggttcgtacccgtccgtttaaccgtacgttaccgacggtacccgaaggtccccgtaacggttccccttaacgtaccggtaaccctaacggtttccgtccgggtaccggtccggtaacgggtacggtcggggtaacggggtaaccgccgttacgtttaaggttactttacggttacgtcgggttactttcgggaacttcggtaccggttaggcgtttaaacgggtggttaccgggggtaaccggtacggtaacgggttccgggaagggtaccggtaacggtaccggtacggggtacccttaccggggttaccgaacggcggttaaccgtaccggtacccggtaacccgtccccgggtttcggaacctcccgg

SEQ ID NO: 169006 - DNA, 796 bp, Homo sapiens
  misc_feature: GYAE6OF02HGXBD.49.82.H05.1.454.CMB.1.raw
  modified_base (230)..(230): a, c, t, g, unknown or other
  misc_feature (230)..(230): n is a, c, g, or t
tcagagtcgagagacacgaccggtgctcgatttagtcgagctctctcgcgggggggtcgacgaagaggcagcgctctcgggacgtcgtccaccatcggcctgggctctgctgctcctcactctcctcactcaggacacaggtcctgggcccagtcctggaccctgactcacgccctgccctccgtcgtcctgggttctcccgtggacaggtcgatccactatcctcgtcncactacgaaaccagctacgtgtagtccggttaggtaactttaacgttaaccttttactaccgttacgtaacctaactaaaccacccgaacggtaccaaaccgaccccaacctaaccatacctattactagtacgaccgatcgaacgccggcctaacggtacggtaccgtcgacgtacgtacgtcgttaccttcgtcggtccctaccggtccgtttcgccggtacgacgtacccggtacgtcccgtttaaccccacgtaaccgtactaacccgttcggtcggttacccgcccggttaacgggcccgggttaaggggacccggtaagggtcccgtaagtttacgggttaattaccgtttacggtacgttacctttacggtactttacggtccgggtacggttacgttaacggtacggtttcgggaaccgtttaaggggtttccgggttaccggggtcggggaaacgggggttaccgggaaaacgggtcggttacccgggtttacggacgggttaaccggtccggaacccgtaaccgggtccttacccggacccgttcccggtaaccgg

SEQ ID NO: 169007 - DNA, 643 bp, Homo sapiens
  misc_feature: GYAE6OF02JNZPT.49.82.H05.1.454.CMB.1.raw
  modified_base (237)..(237): a, c, t, g, unknown or other
  misc_feature (237)..(237): n is a, c, g, or t
  modified_base (439)..(439): a, c, t, g, unknown or other
  misc_feature (439)..(439): n is a, c, g, or t
  modified_base (520)..(520): a, c, t, g, unknown or other
  misc_feature (520)..(520): n is a, c, g, or t
  modified_base (533)..(533): a, c, t, g, unknown or other
  misc_feature (533)..(533): n is a, c, g, or t
tcagagtcgagagacacgaccggtgctcgatttagtcgagctctctcgcgggggggggtcacaagaggcagcgctcgtcgggacgtctccaccatggcctgggctctgctgctcctcactctcctcactcaggacacgagggtcctcgggccagtctcgccctgactcacgcctgcctccgtgtcgtgggtctcctggaccagtcgatcaaccatcgtcctgccactacggaaaccngctaggtcgtatggttaggtaattacttaaccttttcctccgtacgtaaccaaccaacaccgaggacaaaaccgccccaaaactcatactaattttacgtcgacggtccgtatccgacggttcccgacccgtgtacgggtctctagggactcgtcttcgtcgtcgccttcgaacgttgcgcctacgccgtccgcttccgtanacgtaactccgtcggtccggtcctacggcggcggtacggggactaggccttgtaagtttactacgtttgtacgtacgtttnaacgttgtacggngtacgttacgtagtccggtaacgggtaggtacggttccgggacgggtacggaacggtactgtaccggtacgtacgtcgaccgtacgagtcccgtacgtacccgtgtaccc

SEQ ID NO: 169008 - DNA, 741 bp, Homo sapiens
  misc_feature: GYAE6OF02I93PJ.49.82.H05.1.454.CMB.1.raw
  modified_base (197)..(197): a, c, t, g, unknown or other
  misc_feature (197)..(197): n is a, c, g, or t
  modified_base (501)..(501): a, c, t, g, unknown or other
  misc_feature (501)..(501): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacngtcactcacctatctcctgctaactacgaaaccacgctagtgtaagttcggttaagggtaaattttaacttaaccctttttccgtaccgttacggtaaacccaaaaccaacccgaaccccgtaacggaaccctaaaaccgtcccccccaaaacgttcaacgttactaactttagtacggacgggacccgaataccgtaccggaacccggtcccctaacgggtacggggttcctaccgttacggtaactccggttacttcttccgtcgccttcccgtacgtcgtcgcacgtaccgtaccgtcccncctcgtaaccgtacgtcgtacgtccggtcgtccgacgggtcgggacgggacggacgtactagtatttagttctcgtcttcgttatacgttacgtcgggttaccgtgtaacggtacgttacggggtaccggtgggtacggttacgggacgggtaacgggacgtaaacgggtacggtaccggtaaccgttacgtaacgtaccggaccggttaacgtccgtacccggtacccggtcgtacccg

SEQ ID NO: 169009 - DNA, 773 bp, Homo sapiens
  misc_feature: GYAE6OF02GTIXV.49.82.H05.1.454.CMB.1.raw
  modified_base (212)..(212): a, c, t, g, unknown or other
  misc_feature (212)..(212): n is a, c, g, or t
  modified_base (610)..(610): a, c, t, g, unknown or other
  misc_feature (610)..(610): n is a, c, g, or t
tcagagtcgagagacacgaccggtgctcgatttagtcgagctctctcgcggggggggtcacaagaggcagcgctctcgggaccgtctccaccatggcctgggctctgctgctcctcactcctcctcactcaggacacgagggtcctgggcccagtcctgccctgactcagcctgcctccgtgtcgtgggtctcgtggacagtcgatcacctntctcctgccactcgaaacctgctagtagagttggtaggtaactttaacttaacccttttctaccgtcggtaaccaaccaacctacccgacgacctaaacccgacccctaaacctacctaactcctatttacgtggacgtcccgacgtaccgacggccggtacccgtacggtacgggggtccttcgtagtaccgtcggttacttccgtcgtcggtacccttcgtacgtcggttacgaccgtacgaccgtcccggttccctccgtaccgtaacctaccgttccgtaccgggtccgggtccgttaaccccgggtgggtacccgggtacgggggtaaccgtcgggtaccgtttagttaaaccgttttcgttttaagttacgttccggtttacggtttaaccncgttaacggtccgggttacgtacggtacgggtaacggttccggggacggttaacgggggttccgggtacggggacgggtacggtaacggtaaccgggtcgtaacccgggttcggttacgaccgtacggaccgtaccggtctaccccggccccgttactacccg

SEQ ID NO: 169010 - DNA, 668 bp, Homo sapiens
  misc_feature: GYAE6OF02ICKN8.49.82.H05.1.454.CMB.1.raw
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (401)..(401): a, c, t, g, unknown or other
  misc_feature (401)..(401): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccagacagtgatgttagggaatttacgttaaccttttctctagtaccaacaaccaccagacaacgccccaaaactcactactaatttanagacggcgatcacgccgccgtcgtagggtctcgngatccgtcttactcgtgacctccacgtcctggacagccgacgtccccgtacccgtnaacgtaacttcccgtgtcgggcccttaccgtagggccgtaagggggaccggaaggtcctaaggttaatttaacgtttagtttcgcgttagtttaccaagttacgttggccgggtacgtaggttaacggttgggaacccggttaaggggtttcgggttacgggagggaaacgggaaccggtaaagggttaccggaacccgtccggtttaaggtacccgtaccggacccgtaacggtacccttaccggtaccccccgtacggttacccg

SEQ ID NO: 169011 - DNA, 770 bp, Homo sapiens
  misc_feature: GYAE6OF02JHS5W.49.82.H05.1.454.CMB.1.raw
  modified_base (239)..(239): a, c, t, g, unknown or other
  misc_feature (239)..(239): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcagacacgtagggtcctgggcccagtctcgccctgactcagcctgcctcgtgtcgtgggtctcgtggactagtcgtactccacctagtctccgtgacctactcgaaaacccngtcagtcgtagtggttaggtaattaacttaacctttctccgtacgtaaccaaaccgaacctaccgaggaaccaaaccgacccccaaacgtactaactacttaatttagtacgaaccggtaccgattaccgaacggtcccgtccctacgggtacgggttacctcgttaacgtgtccttacgttcgttccgcggtccttcccgtaaccggttcgtacgtacgaccgaccggtacccgcccgttacccgtcaaacgtacgttcccgtacggtccggtacctccggtacgggtcgggtacgggacgggtaacggttcttaacggtaacgtttacgttaagtccgttgtttcgtaactagtacgttacggtcggttaacggtaagttcgggtaccggaaacgggtttgggtcgggttaacgggaccgggtaagggaaccggtaacgggtacccggtaccgttacccggtaacgtacccggtaaccggtacccggtaacccggtccgtccccggttacccggtaccgttaccccggg

SEQ ID NO: 169012 - DNA, 912 bp, Homo sapiens
  misc_feature: GYAE6OF02HLGB8.49.82.H05.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacgacgggtccgttcgggcccagtctcggccctggacctcgacgtcctcgcccttccgtgtcgtcgggtcctcgtacggactggtaccgtntaccacctactctcctgcctaacgtacgaaaccacgtccgtagtacggtagttacgggttagggttaaactttaacttttaacccttttccgtcccgttaacggtaaaccctaaaacctaaacccaaaccccggacggtaaacccgaaaaacccggtaaccccccaaaacgttaccaacttaaccgttaagttttaacggaccggtacggtaccggtaacgtccgtaaccgggcccgttacccggtacgggtaacgggttcctcggttacgtaaccggttccttccgttaccgtttcggtcccggttaccgtacccgttaccggttcggtaccggtacgtaccgaccggtacccgttcccgtaccgtaacgtaacctcgtttaccgtccgggtccgtacccgtaccgggtcgggaccgggttacgggggaaccgtgggttacttacgttttaacgtttacgtttcggtccgttacgttttacgtcgtacggtttcgtaaccgggttcggttaaacgtacggggttaccgtacgggggttaaccggggttaggggtccgggtaacggggacggggtaacgggtaaaccggtcgggttaaccggttcgggttacccggacgggttaccgaccccggggttacgtaccgggttacccgtttaccccgggtccgttacccgttaaccccgg

SEQ ID NO: 169013 - DNA, 745 bp, Homo sapiens
  misc_feature: GYAE6OF02G632T.49.82.H05.1.454.CMB.1.raw
  modified_base (244)..(244): a, c, t, g, unknown or other
  misc_feature (244)..(244): n is a, c, g, or t
  modified_base (537)..(537): a, c, t, g, unknown or other
  misc_feature (537)..(537): n is a, c, g, or t
  modified_base (581)..(581): a, c, t, g, unknown or other
  misc_feature (581)..(581): n is a, c, g, or t
  modified_base (596)..(596): a, c, t, g, unknown or other
  misc_feature (596)..(596): n is a, c, g, or t
  modified_base (611)..(611): a, c, t, g, unknown or other
  misc_feature (611)..(611): n is a, c, g, or t
tcagagtcgagagacacgaccggtgctcgatttagtcgagctctctcgcggggggggtcacaagaggcagcgctctcgggacgtctccaccatggcctgggctctggctgctcctcactctcctcacgtcaggacacgtagggtcctgggcccagtctgccctgactcagcctgcctccgtgtcgtgggtcctccgtggacagttcgactccgacctatccgtcctgcctaacgtagaaacccngtcgaagtgattgggttaggtaaactttactttaaccgttttcacccgttacggtaaacccaaacctaaccgacccgaagggaaccaaaacccgacccccctaaaactaccgtaacttacttaaacttttacggtacgggaaccggaccctaagtcccgtaaacgggcccggttcccgtacgggtaacggggttccctcgtaaggtccttcggtcttcctccggtacggtcctcgtacggttcgagtccgagtcccgcgtccctcgacaccgtacttcgtcggtccgggtccncggtagggccgggttagggacgtcgtcgttattaacttcggttntacgtccttggttanacggtggttcccggngttaagcggttaccgggacgtaccgggttgggttccggaacggggcgggttaacgaacgggttacgggtacggaccgggtttacaccgggttacacggtacccgcggttcccgcccggttacccgtgttacccg

SEQ ID NO: 169014 - DNA, 855 bp, Homo sapiens
  misc_feature: GYAE6OF02I9DTU.49.82.H05.1.454.CMB.1.raw
  modified_base (213)..(213): a, c, t, g, unknown or other
  misc_feature (213)..(213): n is a, c, g, or t
tcagagtcgagagacacgaccggtgctcgatttagtcgagctctctcgcgggggggtcacaagaggcagcgctctcgggacgtctccaccatggcctgggctctgctgctcctcactctcctcactcaggacacgtacgggtcctcgggccctagtcctcgccctgacctcgagtcctcgccctcggttcgtcgttcgggtcctccgtggacngtaccgtactaccactacttcctaccgtcgacctaactacgaaaccgtgacgtagtgtagttagggttaacgtaatttacctttaacctttcgtaccgtacgtaaccaaccgtaaccgaaccccgaagaaccgaaaccctaaccccgaaactcctactacgttactttaaggaccggtaccggtagtaccgaccgaaccggttcccggcccgttaccgggtcgggttaccgtacgtacgttcgtacccgttacttccggtaccgtccggtcccgtttaacgccggttcggtacgacccgaacgtcccggtaacccgttccccgaacggtacgaacccttacggtcccggtcgttaccgggtcccgtacggaccggggttacggggtccgggtacgtaccgggtactttaagttaactttacgggtttaacgttcggttcttaccggtaacgtttaggtcccgtacgggtacccgttacgggttaggtccggggttaacggtacggggtttacgggttacggggtaccgggaaggttaaccgggttaacgtacccggggttacctaccgggtttacgaccggttaaccgtacccgtaccgggttccggtaaccggttcccccggttaccgttaacccggtccg

SEQ ID NO: 169015 - DNA, 995 bp, Homo sapiens
  misc_feature: GYAE6OF02JL39B.49.82.H05.1.454.CMB.1.raw
  modified_base (68)..(68): a, c, t, g, unknown or other
  misc_feature (68)..(68): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagagtcgagagacacgaccggtgctcgatttagtcgagctctctcgcgggggggtcacaagaggcngcgctctcgggacgtctccaccatggcctgggctctgctgctcctcactctcctcactcaggtaccacgtaacgggtcctcgggcccctaaggttccttcgggccccttaggaccttcgaacgtcccgtaggtccctccggttgttacgtgggtcctccgtaggacctaggttccgacttccgtaaccctatttcctaccgtacgtaccaccgttaacgaaaaaccgngtccctaacggttgtacgttacgggttacggttaaactttaacctttaaccttttcncccggttaaggtaacccctaaaccgttaacccacccgacggtaacctaaaccccggtacccctaaactccgttacttacttacgtttaacgtacggaccggtacccttacgtaccgtacgcccgggtacccctacgggtacgggtttcctaccgtacggtaccgttccgttacccgtttaccgttcgttcccggtaccgtttaccctaacgggtttccggtcgtaaccgacccgggttaaccgtaccccgggttcccttaaacccggttccgtaaaccgtaacctttaccggttccgggtttacccggtacccgttaacccgggtacggggttaccgggtaccgggggtaacccggtacgtaccgtttacggtttaaaccttttacggtttaaccggtttccgtttaccgttacgggttaccgttaacgttacccgttccggggttaccggttaccggtttaacggtaccggttaccgggttacgggtaaccggggtttcggttaaccggggtaccgggtaaacgggtacggtaacccgggttaacggtacccgggtttaaccggtccggtttaccggacccggttaaccgggaacccggtttcccgggtaccccggtttaccccggttcccggttaacccg

SEQ ID NO: 169016 - DNA, 853 bp, Homo sapiens
  misc_feature: GYAE6OF02HS4B2.49.82.H05.1.454.CMB.1.raw
  modified_base (238)..(238): a, c, t, g, unknown or other
  misc_feature (238)..(238): n is a, c, g, or t
tcagagtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctcgccctgacctcagcctgcctcgtgtctgggtctccgtggacagtcgactacgaccatcctcctacgactacgtacgaaaaccngacgtagtcgtacgttgggttagggtaaactttacgtttaaccccgtttttccgtaccgttaccggttaaacccaaaacctaaacccgaaccccgtaacggaacccgaaaaccccggtaaccccccctaaaaaccgtacctaacgttaacctttaaacgtttaacgtacgggaaccggtacctaacgtaccgtaccgggtaccccgggtacccttacgggtaaccggggttccgttaccgtacgtaaccgttccgttccgtttcgttaccggtcggtacccttacccgtaacggtttccgacggcgtaaccgtcccgacccgggtccctcccgtacgtaacctaacgtccgttaccgggtaccggtccgtacggtaacgggtccgggtaggggaccggacggttacgttaacgttagttactttcgttgtacgtttcgttaacttacgtacgtacggtacggttagtacgtacgggttcgggtaacggtaacggggtttcggtaccggggacggggttaacggtaaccggtaagggtacccggttaccggtaaccggttacgtaccggaccgtaccggtacccggtccgtaccccggttccggtacgttaacccg

SEQ ID NO: 169017 - DNA, 341 bp, Homo sapiens
  misc_feature: GYAE6OF02IJ5C5.49.82.H05.1.454.CMB.1.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (310)..(341): a, c, t, g, unknown or other
  misc_feature (310)..(341): n is a, c, g, or t
tcagagtcgagagacacgaccggtgctcgatttagtcgagctctctcgcgggcacgaccggtgctcgattttagtcgagctctctcggcgggcacgaccggtgctcgatttagctctacgctcaggggcacgaccggtgctcgactttagagagagtgtgttgggtttgggggaagaggaagactggaccggtcccccccgagggtacgttcgaggtcgcgtcggcaccagccggtccctgggcctgcctggtacaacggactaccgttcctctctcgactcgtgaggcggcgnggacgaggcncagngnnnnnnnnnnnnnnnnnnnnnnnnnnnnnnnn

SEQ ID NO: 169018 - DNA, 761 bp, Homo sapiens
  misc_feature: GYAE6OF02HFEFR.49.82.H05.1.454.CMB.1.raw
  modified_base (580)..(580): a, c, t, g, unknown or other
  misc_feature (580)..(580): n is a, c, g, or t
tcagagtcgagagacacgaccggtgctcgatttagtcgagctctctcgcgggggggggtcacaagaggcagcgctctcgggacgtctccaccatggcctgggctctgctgctcctcaatctcctcactcaggacacgagggtccgtgggcccagtctcgccctgactcagcctcgcctcgtgtcgtcgggtctccgtcggactaggtcgactccaccactcctccgtcgacctactaacgaaaaccacgtacacggtgtagttggtagggtaacttacgtttacctttctccgtacgtaaccaaccaaccaccgacggacaacccgtaccccaactctacgtactattacgtacggacgactacgtcgacgccggtacccgtggtacggtcctactcggtactccgttcttacgtcgtccgtcctaccgtccgtacggacgtaccgaccggcccgtacccgtcccctaccgtaacgtaacctacctccggtccggtcggtccgtaccgggagggtacccgggtagggaccgggtgtaccgttaggtttactttaacggttacgttcgttacgttacgttntaagttacggtccggttacggtagtaggttacggggacgggttaccggtagggggttccgggtacggggaccgggtaacgggtaaccggtacgggtaacccgggttaacgtccgggttaacccggtggtacccggaaccgtcccgggttaacccggtccccgtacccgggttctaccccgg

SEQ ID NO: 169019 - DNA, 767 bp, Homo sapiens
  misc_feature: GYAE6OF02FOI9K.49.82.H05.1.454.CMB.1.raw
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (567)..(567): a, c, t, g, unknown or other
  misc_feature (567)..(567): n is a, c, g, or t
tcagagtcgagagacacgaccggtgctcgatttagtcgagctctctcgcgggggggggtcacaagaggcagcgctctcgggacgtctccaccatggcctgggctctgctgctcctcactctcctcactcaggacacacgggtctcgggcccagtctcgccctgactcacgcctgcctccgtgtctgggtctcgtggacagtcgatccaacctntcctcctgcctacgtacgaaaccngcagtgacgttggtaggtaattacttacctttctcgtacgtaaccaaccaaccgaccgaggaccaaaccgacccctaaacncctaacttaccgtaagttacgtacggacggcctacgtacgacggtcccggtaccctacgggtacggggttctcggtagtacttccgttaccttccgttcggtccgtaccgtccctacggttccgtcggaccgaacggtccgacccgtccctaccgtacgtaactacgtccgtccggtggtacccgtacggtacggtccgggggacgggacccgggtgtacggtttaaggtacttttacggttacgggtnttacgtttacgttacgtaactttcgggtccggttcgggtagttaacgggttccggggtaccggggttaaccgggttagggggttcccgggttaggggaaccgggtagggtaaaccggtacgggtcccggtaccgggttacgtaccgacgggtaaccgtacccggtacggtcccgtaccccggtccccgttacgggtaccc

SEQ ID NO: 169020 - DNA, 792 bp, Homo sapiens
  misc_feature: GYAE6OF02I8GOE.49.82.H05.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagagtcgagagacacgaccggtgctcgatttagtcgagctctctcgcggggggggtcacaagaggcagcgctctcgggacgtctccaccatggccctgggctctgctgctcctcactctcctcactcaggacacaggtctgggccagtctcgccctgactcagtcctcgcctccgtgtccttgggtcctccgnggacagtcgatccactactctcctgaccacgtacgaaccngcagtnagttgtaggtaatttacttaacctttctaccgtacggtaacccaactaaccgacccgaacgaccaaaacccgacccctaaactcgtacttactactttacggacggacggtaccgtataccggcggaccgtcccgtacggtacgggttcctcgttacgacgttccgtcttcgttcgtccggaccgttccgtacgttcgacggtacgtacggccgtacccgtaccttccgaacgtactaccgtccgtacggtccggaccgtccggtacggtacggggacgggtaaccggtgttccgtaaggttttacttaaaggtttccgttggttacccgtaagtttccgtaacgttacggttaccccgggtgttaacggtaacgttaccggggtaaccggggttaacgggtaaggggtttaccgggttaccgggggacgggttaacgggtaacccggttaagggttaacccggttaccggtaccggttacgggtaaccaacccggggttaccggtaacccggtccgggttccccctaacccgggttccggttaacccccg

SEQ ID NO: 169021 - DNA, 526 bp, Homo sapiens
  misc_feature: GYAE6OF01DYGSE.4.72.G06.1.454.CMB.1.raw
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
  modified_base (518)..(526): a, c, t, g, unknown or other
  misc_feature (518)..(526): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggccgttattactgtgcgagacatccgggggctcggatattgaactaatggaaaaagttccgggtaccgctaaacaacaggttcgagtcctgggccagggaaccctggtcaccgtctcctcagcctccaccaaggcccatcggtcttcccctggcaccctcctccaacgacgcaccctcgtcgggggcacgacgccggccctgggcctggcctggtcaacggactacttccctacngtgctctgaggcgggctggcaaggcgnatgnnnnnnnnn

SEQ ID NO: 169022 - DNA, 610 bp, Homo sapiens
  misc_feature: GYAE6OF01DW7RW.4.72.G06.1.454.CMB.1.raw
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(610): a, c, t, g, unknown or other
  misc_feature (608)..(610): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaaagcgcacagcgtacatggaactgaggagcctgagatctgaagacacggccgtttattactgtgcgagacagtccgggggctcggatagttgaactaaagtaggtaaaaacgttccgggccgactaaaacaacgaggttcgacgtccgtgggccagggaaccctggtcaccgtctcctcagccctccaccgaacgggcccagtcggtcccttcccccgtggccaccctcctccaacgacgccacccgtcgtcggggcaccgacgccggcccgtgggcctcggcccgtggtaccgaacggtaccttaaccctttccccgtaacgtacggttcgtccttccgtaggacgggtcccgggtctcgggaccgaaacgggtccgacgaacgtacggcncgngtcngncnnn

SEQ ID NO: 169023 - DNA, 593 bp, Homo sapiens
  misc_feature: GYAE6OF01DXJCE.4.72.G06.1.454.CMB.1.raw
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgccgtatggcaaacaatgcacagaagttccaggcagactcacaattaccgcggacaagtccaagcgcacagcgtacatggaactgaggagcctgagatctgaaagcacggccgtttattactgtgcgagacagtccgggggctcggatagttgaactaatggaaaaagttccgggtaccgctaaaacaacaggttcgagtccgtgggccacgggaccctggccacgtctctcagcctccacaagggcccatcggtccttcccctggccaccctcctaccaacgacgccacctccgtcgggggccaacgacggccggcccgtgggcctggcccctgggtccaacgggtaccttaacccttccccgtaactacggtacgccgttcgtcggacggcggggtacctcgggaccgaacgggtccggacgaacgtacgcgancgtancnncngngn

SEQ ID NO: 169024 - DNA, 615 bp, Homo sapiens
  misc_feature: GYAE6OF01DVLRQ.4.72.G06.1.454.CMB.1.raw
  modified_base (194)..(194): a, c, t, g, unknown or other
  misc_feature (194)..(194): n is a, c, g, or t
  modified_base (605)..(605): a, c, t, g, unknown or other
  misc_feature (605)..(605): n is a, c, g, or t
  modified_base (609)..(615): a, c, t, g, unknown or other
  misc_feature (609)..(615): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgnggacaagtccaagcgcacagcgtacatggaactgaggagcctgagatctagaagacacggccgttattactgtgcgagacagtccgggggctcggatagttagaactaagtaggtaaaaagttccggaccgactaaacaacgtaggttcgagtccgtggggaccacgggaaccctggtccaaccgtcctccgtcacgccctccgaaccgaacggggccccaacgttccggtaccctttcccccgtggccctacccctccctcccgaagtacgccacctccgtggggccacgacggccggccccgtgggcctcggccgttcgggtaccaacgggaccttacccgttccccacgtaacgtcgcgttcgcggacggccggggtcctcgggaccgtaagggccgacacggtagcnacgnnnnnnn

SEQ ID NO: 169025 - DNA, 632 bp, Homo sapiens
  misc_feature: GYAE6OF01EXTD0.4.72.G06.1.454.CMB.1.raw
  modified_base (617)..(617): a, c, t, g, unknown or other
  misc_feature (617)..(617): n is a, c, g, or t
  modified_base (623)..(623): a, c, t, g, unknown or other
  misc_feature (623)..(623): n is a, c, g, or t
  modified_base (626)..(627): a, c, t, g, unknown or other
  misc_feature (626)..(627): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggtccgtttattactgtgcgagacagtccgggggctcggatagttgaactaagtaggtaaaaacggttccgggtaccgtactaaaacaacgtaggttacgacgtccgtggggccgagggtaaccctggtaccaccgtctccgtcgacgccctaccaccgaacgggccccacgttccggtcccttcccccgtcggccctaccccgtccctaccgaacgacgcccacccgtcggtcggggacaccgacgccgacgcccgtgggcctcgcccgtgggtaccaacgggtaccttacccgttccctaacgtcggtcgcctcgtacggacggtccgggtcgtcggaccggtaacgggccgtacgacgtcggngcgacncgnngtngn

SEQ ID NO: 169026 - DNA, 634 bp, Homo sapiens
  misc_feature: GYAE6OF01DS2MX.4.72.G06.1.454.CMB.1.raw
  modified_base (233)..(233): a, c, t, g, unknown or other
  misc_feature (233)..(233): n is a, c, g, or t
  modified_base (625)..(625): a, c, t, g, unknown or other
  misc_feature (625)..(625): n is a, c, g, or t
  modified_base (630)..(631): a, c, t, g, unknown or other
  misc_feature (630)..(631): n is a, c, g, or t
  modified_base (633)..(634): a, c, t, g, unknown or other
  misc_feature (633)..(634): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatccaccctaccctgcctatggcaaacaatgcacagaagttccagggcagactcacaattaccgcggacaagtccaagcgcacagcgtacatggaactgaggancctgagatctagaagacacggtccgtttattactgtgcgagacgagtccgggggctcggatagttagaaacgtaagtaacgggtaaaaacgttccgggtaccgaactaaacgtaacgtacggttacgagtccgtacgggaccgacgggaaccgtcggtaccaccgtctccctcgacgccctaccaccgaacggccctacgtccggtcccttccccgtcggccctacccctccctaccgaacgcgtcccaccgtccgtcgggctacgacgccggtcccgtgggcctcggccgtcggtacaacgggccttaacccgttcccgtacgtacgtcgtccttacgtcggacgggtccggcgtccggacggacggcccgtaacgagtacggctagccgntcganngnn

SEQ ID NO: 169027 - DNA, 827 bp, Homo sapiens
  misc_feature: GYAE6OF01BCKOE.4.72.G06.1.454.CMB.1.raw
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggacaaacatgcacagaagttccagggcagactcacaattaccgcgacaagtccaagcacacgagcgtacagtacggaactggaggagcctgagatcgtagaacgacgacggtacgttttaatactgtgcgagacgacgtccggggctacggtatagttacgaactaagtaacggtaaaacggttccggtaccgtaacgtaaaacgaacgtaacgggttacgacggttaccggtacggggaccgtaacggggtaacccttcgggttaacccaccggttcccgttacccgtacgtaccgtaccccgttaccgaaacccggaaccgggtacccctaacgttacccggttacccctttacccccgtacggtacccctaccccgttacccgtaccgaacggtacgaccctaacccgttcgggtaccgggggacctaaccggtaccggcccgggtacccggtacggggtcccttaccgggtacccggtttacgggtaaccgtaaaaccgggttacccgtttaaacccgttttacccccgtaaccggttaaccggttccggttacccgtttaccggtacgggtaacccggggtcccggggtacccgttacgggggaacccggtaaaccggggtcccgtaaccgtaagggttaaccgcgacgacgacgtaccgtagacgcgcgacg

SEQ ID NO: 169028 - DNA, 627 bp, Homo sapiens
  misc_feature: GYAE6OF01A4ZIS.4.72.G06.1.454.CMB.1.raw
  modified_base (615)..(615): a, c, t, g, unknown or other
  misc_feature (615)..(615): n is a, c, g, or t
  modified_base (617)..(618): a, c, t, g, unknown or other
  misc_feature (617)..(618): n is a, c, g, or t
  modified_base (620)..(625): a, c, t, g, unknown or other
  misc_feature (620)..(625): n is a, c, g, or t
  modified_base (627)..(627): a, c, t, g, unknown or other
  misc_feature (627)..(627): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgcggacaagtccaagcgcacagcgtacatggaactgaggagcctagagatcgtaggaaagacgacggtccgtttaattactgtcgcgagacagtcccgggggctcggatagttgaactaagtaggaaaaacggttccgggtaccgactaaaacaacgtaggttacgacgtccgtcgggaccgagggtaaccctcggtaccaccggtctccctcacgccctcctaaccgaacggggcccctacgtccggttccttcccccgtggccctacccctccgtacccaacgtacgccacccgtcggtcgggggacctacgacggtccgcccggtggcctcggtccgtcggacctaacggacctaccttcccgtactacgtcgccgtcgtcggacggtccgggcgtgggaccgtaggccgtacgaagtcgngnngnnnnnngn

SEQ ID NO: 169029 - DNA, 630 bp, Homo sapiens
  misc_feature: GYAE6OF01COADJ.4.72.G06.1.454.CMB.1.raw
  modified_base (286)..(286): a, c, t, g, unknown or other
  misc_feature (286)..(286): n is a, c, g, or t
  modified_base (430)..(430): a, c, t, g, unknown or other
  misc_feature (430)..(430): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (627)..(627): a, c, t, g, unknown or other
  misc_feature (627)..(627): n is a, c, g, or t
  modified_base (629)..(630): a, c, t, g, unknown or other
  misc_feature (629)..(630): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctagagacacggccgtttattactgtgcgagacagtccggggggntcggatattgaactaagtaggaaaacgttccgggtaccacgtaaacacgtaggttcgacgtccgtgggccacgggaacctggtacaccgtctccgtcacgccctaccaccgaacggcccagtccggtccttcccccgtggcccncccctccaccgaacgcgcctaccgtcgcggggaccacgcggccggcccgtcgggtcctcggcccgttcggtaccgaaacggtaccccttaaccgtttacccccgaacgtaccggttcgtacccgttcggtacggaccggggtccgggtccgtacgggaccgtaacggggccgacgtaacgtaggcatcncgangacngnn

SEQ ID NO: 169030 - DNA, 918 bp, Homo sapiens
  misc_feature: GYAE6OF01B2WNB.4.72.G06.1.454.CMB.1.raw
tcagagcactgtagcacgaccggtgctcgatttagctacgactgcaagggaaagggaggcaccttcagtacgtttgatatcaattgggtgcgacacggcccctggacaaggtcttgagtggagtgggaaggatccaccctaccgtgcctatggacaaacaatgcaacaaggaacgttccgaagggcaagacctacaactaaacgttacccggacggaaacaacgtaccgaaacgccgacaacgacgacgtaacagtacggaacgtaggaggtacgaccgtaggagtattcgaaggaacgacggtaaccggtacgttttaagttacgtaggtacgacgggaacgacggtaccggggtaccgggggacttacggtaattacggtaacgtaaaacggttaaaggtaacgggtaaaaccggttccggaaccgtaaacgtaaaccgtaaggttaacggtacggtaacggtccgggtaacggggaccgtaaccgggtaacccgttccggtaccgtacccgtaccgtacccgtacgtacccgtaccccgtacccggaaaccggtaacccgggacccttaaccgggttcccggttacccccgtacccgtaccggtacccctacccgtcccgtaaaccgaacggtacccgacccggtaccggtaccggggtacgggacccgaacggtcccgggaccccggttcccgggtacggtacccggttccggtacccggtacggggtaaacccctaaacccggggtttacctttaccccgtaacccggttaccgggtaacgtcccgggttaacccgttacggacggggtaccgggtacccgggggacgtaccccgggttaaagggaccccgggtaaccgtaggtaaagttaccgggaacccttgggaccaagccgttaagaacgcggttagcg

SEQ ID NO: 169031 - DNA, 601 bp, Homo sapiens
  misc_feature: GYAE6OF01BKU0V.4.72.G06.1.454.CMB.1.raw
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (587)..(587): a, c, t, g, unknown or other
  misc_feature (587)..(587): n is a, c, g, or t
  modified_base (592)..(593): a, c, t, g, unknown or other
  misc_feature (592)..(593): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatccacccctaccctgcctatggcaaacaatgcacagaagttccagggcagactcacaattaccgcggaacaagtccaagcgcacgagcgtacagtggaactgaggacgcctgagatctagaacgacgtaccggtcgttttattacgtgtgacgagacgacggtccgggggctcggtattagttagaactaagtagggtaaaacggttccgggtaccgactaaacacgtaggttcgacgtccggtgggccgacgggacccgtgtccaccgtctccncncgcctccacgacggcccagtccggtccttccccgtcgccctaccctcctaccaacgcgaccaccgtcggcgggcaccgacggccggtcccgtggccgtcgccgtcggtaccaacggtccttacctaccgtacgtcgtacgctcgagcggcggcgtcggacggaacggcgacgaagtgcgncgctnncgngngcg

SEQ ID NO: 169032 - DNA, 867 bp, Homo sapiens
  misc_feature: GYAE6OF01AOXCT.4.72.G06.1.454.CMB.1.raw
  modified_base (95)..(95): a, c, t, g, unknown or other
  misc_feature (95)..(95): n is a, c, g, or t
tcagagcactgtagcacgaccggtgctcgatttagctacgactgcaagggaaagggaggcaccttcagtacgtttgatatcaattgggtgcgacnggcccctggacaagggcttgagtggatgggaggatcacccctaccctgcctatggcaaacatgcacagagttccagggcagactcacaattaccgcggacaagtccaagcgacacagcgtacagtggaactggaggacgcctaggagtatcgtaggaaacgaccgtaaccgggtaccgttttaattacgtggttacggaccggtaacggtaaccgaacgggtcccgggggggtacctaccgggtaattaagttacgaaacgttaaagtaacgggtaaaaacggtttcccggggtaccgtaacgtaaaaccgtaaccgtaacgggtttaccggacggttacccggtacggggtacccgaacggggtaacccgtcgggtacccgtacccggttaccgtacccgtacgtaccggtacccgttacccgaaccggtaacccggggtaccccgtaacggttccccggttaccccgtttaccccccggtacgggtacccctaacccccgtttcccctaacccgtaacgtacccggccctaaacccccggtcggttaccggggggaccctaaccggaccgggtacccggtccccggtcggggtacccttcgggtacccggttaccgggtaccgtaaccgggtacccttaacccggttaccccgtaacggttacggttccgtaccgtaccgttacgggaccggtccgggtacgttaccggggaaccgaacgggtcccgtaagtaacggtacgcgaccgtcgactacgaccgctagctacgg

SEQ ID NO: 169033 - DNA, 943 bp, Homo sapiens
  misc_feature: GYAE6OF01BUNYZ.4.72.G06.1.454.CMB.1.raw
  modified_base (935)..(935): a, c, t, g, unknown or other
  misc_feature (935)..(935): n is a, c, g, or t
  modified_base (939)..(939): a, c, t, g, unknown or other
  misc_feature (939)..(939): n is a, c, g, or t
  modified_base (941)..(941): a, c, t, g, unknown or other
  misc_feature (941)..(941): n is a, c, g, or t
  modified_base (943)..(943): a, c, t, g, unknown or other
  misc_feature (943)..(943): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatccaccctaccctgcctatggcaaacaatgcacagaacgttccagggcagactcacaattaccgcggacaagtccaagcgcacagcgtacagtaggaactggaggacgcctagagtatcgtaggaaacgaccgtaccgggttaccgttttaattaaccgttggtaggaccggaacggtaaccggtacgggttacccgggggggacgttaccggtaattaagtttaacggtaaaaccgtttaaaggttaacgggttaaaaaacgggtttccccggggtaacccgtaaaccgttaaaaaccgaaccggtaacgggtttaccggtaacggttacccgggtaccggggtaacccggtaaccggggtaaccccgttccgggtacccgtaccccggttacccgttaccccgttaccgaacccggtacccccgttaaccccgaacccggtaaaccccggggtaccccctaaccggtttcccccggtttacccccgtttacccccccggttccgggtacccccttaccccccgttaccccgttaaccccggaaaccggtaccccggtaccccgttaaccccgttccggggtacccgggggaacccctaccgggacccgggtcccccgggtaccccggttcggggtcccgttccgggcccggtttacggtaacccggtaacggttaaccccttacccgtttacccccgtaacgttaccgggttccgtacccgtttaccggtacgggtaacggtccccggggtacgtccgggaaccgggtaacgggccgtaacgacgtacgggacagcgtacgcngcgngngn

SEQ ID NO: 169034 - DNA, 825 bp, Homo sapiens
  misc_feature: GYAE6OF01BA3YN.4.72.G06.1.454.CMB.1.raw
  modified_base (236)..(236): a, c, t, g, unknown or other
  misc_feature (236)..(236): n is a, c, g, or t
  modified_base (814)..(814): a, c, t, g, unknown or other
  misc_feature (814)..(814): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatccacccctacctgcctatggcaaacatgcacagagttccagggcagactcacaagttaccgcggacaagtccaagccgcacagcgtacatggaactggaaggacnccgtgacgatcgtagaaacgacgtaccggtccgttttaattacgttggtcggaccggtagaaccgacggttcccgggggggactccgggtattaagttagaaacgttaaagttaacgggtaaaaacggtttcccggggaccgtaactaaaaccgaacggtaggtttaccgacgttacccggtaggggacccgtaacggggaaccccgttggtacctacccggttcctcccttaccgacgaccccctaccgaaccgtacccgggtacccgtaccgttccgggttacccctttcccccggtcggtaccccgtacccccttaccgtaccccgaacgtaccgtacccgtaccccggtccggtaccggggtaccgaacccggaccggacccgggttacccgggtaccgggtccggtccggtacccggtaccgggtaaccggtaaccggttacccgtttaccccgttaccccgttacggtaaccggtccgttaccggttccggtacggccgggtaccggggtccgtaccggggaccggtaccggggaccggtaccgtaacggttacggcggtacttacggacgngagcgcgcgcg

SEQ ID NO: 169035 - DNA, 854 bp, Homo sapiens
  misc_feature: GYAE6OF01AJBKT.4.72.G06.1.454.CMB.1.raw
  modified_base (840)..(840): a, c, t, g, unknown or other
  misc_feature (840)..(840): n is a, c, g, or t
  modified_base (843)..(843): a, c, t, g, unknown or other
  misc_feature (843)..(843): n is a, c, g, or t
  modified_base (846)..(846): a, c, t, g, unknown or other
  misc_feature (846)..(846): n is a, c, g, or t
tcagagcactgtagcacgaccggtgctcgatttagctacgactgcaagggaaagggaggcaccttcagtacgtttgatatcaattgggtgcgacacggcccctggacaagggcttgaggtggatgggaaggatccaccccctaccctgcctatggacaaacaatgcacagaagttccagggcagactcacaacttaccgcggacacgtccaagcgcacgagcctacatcgggaactggaggagccgtagagtatccgtaggaaacgtaccgaccgggttacccgttttaagttacgttacggtcgaccggtaacgtaccgtacggggttcccgggggggtacttacgggtaactttagtttaaccggtaaaaccgtttaaaggttaacgggtaaaaacggtttccccggggtaacccgtaaccgttaaaaaccgaaaccgtaacgggtttaccggaacggttcccggtcggggtacccgaaccggggtaaccccgttcgggtacccgtacccggtccttcccgtccgaccgtaccctacccggaaccgaaccgggccccgtacgtcccggttccccttccccggtccggacccctacccccgtccctaccgaacggtaccgtaccctacccggtacggtcggggacctaccggaccgggtccccggtacccggtcgggtccgtacccgtccggtacgggtaacccgaacggttacccgtttaacccgttacccgtaccgttcggttcgtacccgttcggtaccgggaccgggtcccggggccgttaccggggtaaccgaacgggtcccggtacgtaacggtcggacgtacgccgtaccgnacncgngtcgtacg

SEQ ID NO: 169036 - DNA, 521 bp, Homo sapiens
  misc_feature: GYAE6OF02HQPGY.4.72.G06.1.454.CMB.1.raw
  modified_base (498)..(498): a, c, t, g, unknown or other
  misc_feature (498)..(498): n is a, c, g, or t
  modified_base (512)..(521): a, c, t, g, unknown or other
  misc_feature (512)..(521): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgcggacaagtccaagcgcacagcgtacatggaactgaggagcctgagatctgaagacacggccgtttattactgtgcgagacatccggggggctcggatattgaactaatggaaaaagttccgggtccgctaaacaacaggttcgagtcctggggccagggaaccctggtcaccgtctcctcagcctcaccaagggcccatccggtcttccccctggccaccctcctccaacgagccacctctcggggcacgagcggccctgggctgcctggtcaaggactacttccctacagtgctctgagcggcnggcaggcgcatagnnnnnnnnnn

SEQ ID NO: 169037 - DNA, 553 bp, Homo sapiens
  misc_feature: GYAE6OF02I3L73.4.72.G06.1.454.CMB.1.raw
  modified_base (544)..(553): a, c, t, g, unknown or other
  misc_feature (544)..(553): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgcggacaagtccaagcgcacagcgtacatggaactgaggagcctgagatctgaagacacggccgtttattactgtgcgagacagtccgggggctcggatattgaactaatggaaaaagttccgggtccgctaaacaacaggttcgagtccgtgggccagggaaccctggtcaccgtctcctcagcctccaccaagggcccatcggtccttccccctggccaccctccctccaacgacgccaccctcgtcgggggccacgacgccggcccgtcgggcctcggccctcggtccaacgggtactaccgttccctacacgtgccttcgtgacgcgggctggcgaagggcgcagtagnnnnnnnnnn

SEQ ID NO: 169038 - DNA, 552 bp, Homo sapiens
  misc_feature: GYAE6OF02HY732.4.72.G06.1.454.CMB.1.raw
  modified_base (535)..(535): a, c, t, g, unknown or other
  misc_feature (535)..(535): n is a, c, g, or t
  modified_base (542)..(545): a, c, t, g, unknown or other
  misc_feature (542)..(545): n is a, c, g, or t
  modified_base (547)..(552): a, c, t, g, unknown or other
  misc_feature (547)..(552): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgcggacaagtccaagcgcacagcgtacatggaactgaggagcctgagatctgaagacacggccgtttattactgtgcgagacagtccggggggctcggatattgaactaatggaaaaagttccgggtccgactaaacaacaggttcgagtcctggggccagggaaccctggtcaccgtctcctcagcctccaccaagggcccatccggtccttcccccgtggccaccctccctcccaaacgcgccacctcgtcgggggccacgacgccggcccgtgggcctcgcccgtggtccaaggacctaccttccctacagtcgcctcgtgacgcgggctcggcaagggcncagtagnnnngnnnnnn

SEQ ID NO: 169039 - DNA, 540 bp, Homo sapiens
  misc_feature: GYAE6OF02FHIHA.4.72.G06.1.454.CMB.1.raw
  modified_base (404)..(404): a, c, t, g, unknown or other
  misc_feature (404)..(404): n is a, c, g, or t
  modified_base (531)..(540): a, c, t, g, unknown or other
  misc_feature (531)..(540): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggccgttatactgtgcgagacatccggggggctcggatattgaactaatggaaaaagttccgggtcgctaaacaacaggttcgagtcctggggccagggaaccctggtcaccgtctcctcagcctccaccaagggcccatcggtcttcccccnggccaccctcctccaacgacgccacctccgtcggggggccaccgacgccgggccctggggcctgccctgggtcaacgggactaccttccctacacgtcgctctgacgcgggctggcaggcgcatagnnnnnnnnnn

SEQ ID NO: 169040 - DNA, 607 bp, Homo sapiens
  misc_feature: GYAE6OF02GQT1R.4.72.G06.1.454.CMB.1.raw
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (603)..(605): a, c, t, g, unknown or other
  misc_feature (603)..(605): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgcggacaagtccaagcgcacagcgtacatggaactgaggagcctgagatctgaagacacggccgtttattactgtgcgagacatccggggggctcggatattgaactaatggaaaaagttccgggtccgctaaacaacaggttcgagtcctgggccagggaccctggtcaccgtctcctcagcctcaccaagggcccagtccggtccttccccctggccaccctccctcccaacgacgccaccctccgtcggggggccaccgacggccgggcccctcggggcctcggcccgtgggttccaaacgggtacccttaaccgtttccccgtaacgtaacggttcgccgttccgtcggacggtccggggccgtcgggaccgaaacgggcccggacctaacgtacggctagncagncnnncg

SEQ ID NO: 169041 - DNA, 651 bp, Homo sapiens
  misc_feature: GYAE6OF02H2ZFE.4.72.G06.1.454.CMB.1.raw
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (645)..(651): a, c, t, g, unknown or other
  misc_feature (645)..(651): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatccaccctaccctgcctatggcaaaacaatgcacagaagttccagggcagactcacaattaccgcggaacaagtccaagcgcacagcgtacatggaactgaggagcctgagatctgaagacacggtccgtttaattactgtgcgagacagtccgggggctcggatattgaactaataggaaaaagttccggaccgactaaaacaacgaggttcgagtccgtaggggccaagggaaccctggtaccacccgttctaccgtcacgtccctaccgaacccaacggggaccccagttaccggttacccttcccccgtacggccctaacccctccctacccaaacgtacgacctaacccgtccggtacggggggaccaaccgtacggcccgggaccccgtcggggaccttccggccgttacggtaccgaaacgggtacccttaacttccccgtaacgacgttcgccgttccgtcggaacggccgggcgtacggcgaacgggtccgacagtacgngntagnnnnnnn

SEQ ID NO: 169042 - DNA, 604 bp, Homo sapiens
  misc_feature: GYAE6OF02HECWP.4.72.G06.1.454.CMB.1.raw
  modified_base (596)..(596): a, c, t, g, unknown or other
  misc_feature (596)..(596): n is a, c, g, or t
  modified_base (602)..(603): a, c, t, g, unknown or other
  misc_feature (602)..(603): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgcggacaagtccaagcgcacagcgtacatggaactgaggagcctgagatctgaagacacggccgtttattactgtgcgagacagtccggggggctcggatattgaactaatggaaaaagttccgggtccgctaaacaacaggttcgagtcctggggccagggaaccctggtcaccgtctctcagccctccaccgaagggcccatccggtccttcccccgtggccacccgtcctccaagacgccacctcgtcgggggccacgacggccggccctgggcctggcccgttcgggtaccaaacgggaccttacccgttccccgtacgacgtacggtcgtccgttcgtcggacggcccgggtcggtcgggaccggtaaccgggcccggtacgtaacgtaggactcgacgngctcgnnc

SEQ ID NO: 169043 - DNA, 624 bp, Homo sapiens
  misc_feature: GYAE6OF02IN1RD.4.72.G06.1.454.CMB.1.raw
  modified_base (613)..(614): a, c, t, g, unknown or other
  misc_feature (613)..(614): n is a, c, g, or t
  modified_base (617)..(623): a, c, t, g, unknown or other
  misc_feature (617)..(623): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggccgtttattactgtgcgagacagtccgggggctcggatagttgaactaagtaggaaaaacggtttccgggtaccgactaaaacgaacgtacggttcgacgtccgtggggccagggaaccctggtaccaccgtctcctcacgccctaccaccgaacgggcccagtcccggttccttcccccgtggccctacccctccctacccaaacgacgcctacccgtcgtcgggggacaccgacggcccggcccgtcgggcctcggccgttcggtaccgaacgggtacccttaaccgtttcccctacgtacggttcgccgttccgtcggacgggtccgggcgtcgggaccgacgggcgccgagtacgnntcnnnnnnnc

SEQ ID NO: 169044 - DNA, 571 bp, Homo sapiens
  misc_feature: GYAE6OF02GDI55.4.72.G06.1.454.CMB.1.raw
  modified_base (407)..(407): a, c, t, g, unknown or other
  misc_feature (407)..(407): n is a, c, g, or t
  modified_base (559)..(559): a, c, t, g, unknown or other
  misc_feature (559)..(559): n is a, c, g, or t
  modified_base (566)..(567): a, c, t, g, unknown or other
  misc_feature (566)..(567): n is a, c, g, or t
  modified_base (569)..(571): a, c, t, g, unknown or other
  misc_feature (569)..(571): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggccgtttatactgtgcgagacagtccgggggctcggatattgaactaagtggaaaaagttccgggtaccgctaaaacaacaggttcgaagtcctggggccagggaaccctggtcaccgtctcctcagcctccacaggcccatccggtcttccccngccaccctcctccaacgacgcaccgtcgtcggggccacgacgcggcccgtgggctcgccgtcggtccgaacggtacctaccgttccccgtacgtcgtacgccttcgtcggacggtccgggcctcgggccgaacgggccgaccgtaagtaagncgctcgnncnnn

SEQ ID NO: 169045 - DNA, 588 bp, Homo sapiens
  misc_feature: GYAE6OF02HWKZC.4.72.G06.1.454.CMB.1.raw
  modified_base (193)..(193): a, c, t, g, unknown or other
  misc_feature (193)..(193): n is a, c, g, or t
  modified_base (578)..(579): a, c, t, g, unknown or other
  misc_feature (578)..(579): n is a, c, g, or t
  modified_base (581)..(588): a, c, t, g, unknown or other
  misc_feature (581)..(588): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgnggacaagtccaaagcgcacagcgtacatggaactgaggagcctgagatctgaagacacggccgtttattactgtgcgagacagtccggggggctcggatattgaactaatgggaaaaagttccggggtaccgactaaacaacaggttcgagtcctggggccagggaaccctggtcaccgtctcctcacgcctccaccaacgggcccatccggtccttccccgtggcctaccctccctccaacgacgccacctcgtcgggggaccacgacgccggcccgtgggcctggcccgtgggtaccaaagggtaccttaacccgttcccctaacgtacggttcgccgttccgtggacggccggggctcgggacaacggggccacgagtacgnngnnnnnnnn

SEQ ID NO: 169046 - DNA, 647 bp, Homo sapiens
  misc_feature: GYAE6OF02HX426.4.72.G06.1.454.CMB.1.raw
  modified_base (632)..(632): a, c, t, g, unknown or other
  misc_feature (632)..(632): n is a, c, g, or t
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctacctgcctatggcaaacaatgcacagaagttccagggcagactcacaattaccgcggacaagtccaagcgcacagcgtacatggaactgaggagcctgagatctagaacggacacggcctttattactgtgcgagacagtccgggggcttcgggattagttcgaactaataggtaaaaacgttcgggtacccacttaaacgaacgaggtttacgagtcctggggccaagggaaccctggcctaaccgtctccgtcacgtccctccaacgacgggccacttccggtccttcccctgggcctaccccgtctacccaagtacgcctaccgtcgcggggtccacggacgccggtcccgtgggccttcggccgtacggtacctaagggccctttaaccgttcccccgttaacgacggttaccgtccgttaccgttacggaacggtcccggtacgtaccggtaccggtaacgggtccgaccgtaggtacgcgtctcgacngaccgtntcgngtcg

SEQ ID NO: 169047 - DNA, 786 bp, Homo sapiens
  misc_feature: GYAE6OF02FV709.4.72.G06.1.454.CMB.1.raw
  modified_base (772)..(772): a, c, t, g, unknown or other
  misc_feature (772)..(772): n is a, c, g, or t
  modified_base (778)..(778): a, c, t, g, unknown or other
  misc_feature (778)..(778): n is a, c, g, or t
  modified_base (783)..(783): a, c, t, g, unknown or other
  misc_feature (783)..(783): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctaggaaacgaccgtacggtccgttttaagttaaccttggttaggccgaagaacacggttcccgggggggctaccgggattagttgaaacgttaagtagggtaaaaaacggtttccgggtaccgacttaaaacgaaccgtagggttaccgagttccgtggggcccgaagggaaccccgttggtaccaccgtcctccgtacacgtccctccacccgaacgggcccagtcccgggtaccctttccccccgtcggaccctacccccttacccgtacccgaaacggtaccgccctaaccccgttccgggtcggggggtaccccaaaccggtacccggggtccccgggtacccccggttcgggggtacccttaccggggtccccgttacgggttaccccggaaacggggttaccccttaacccgtttttaccccccgtaacgtaccgggttttcccgaccgtttccgttcggggtaaccgggcccggggtacgttccgggaccggtaaacgggccggaccgtaagtacggatcganctacgncgagnacg

SEQ ID NO: 169048 - DNA, 581 bp, Homo sapiens
  misc_feature: GYAE6OF02FFWUB.4.72.G06.1.454.CMB.1.raw
  modified_base (426)..(426): a, c, t, g, unknown or other
  misc_feature (426)..(426): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (576)..(576): a, c, t, g, unknown or other
  misc_feature (576)..(576): n is a, c, g, or t
  modified_base (578)..(580): a, c, t, g, unknown or other
  misc_feature (578)..(580): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggtccgtttatactgtgcgagacagtccgggggctcggatatgaactaagtaggaaaaacgttccgggtacgacgtaaacaacgtacggttacgagttccgtggggaccagggaaccctggtccaccgtctcctcacgcctccaccgaacgggcccagtccggtccttcccccgnggccctaccctcctccagacgcaccgtcgtcggggcacgacgccggccgtcgggctcgccgtcggtaccgaacggtacctaccgttccctacgacgtcgtccgtctcggagccgggcgtggacgacggccgacgagtacgnngntcacgncnnnc

SEQ ID NO: 169049 - DNA, 570 bp, Homo sapiens
  misc_feature: GYAE6OF02HSDPD.4.72.G06.1.454.CMB.1.raw
  modified_base (394)..(394): a, c, t, g, unknown or other
  misc_feature (394)..(394): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (556)..(556): a, c, t, g, unknown or other
  misc_feature (556)..(556): n is a, c, g, or t
  modified_base (562)..(564): a, c, t, g, unknown or other
  misc_feature (562)..(564): n is a, c, g, or t
  modified_base (566)..(570): a, c, t, g, unknown or other
  misc_feature (566)..(570): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctagaagacacggtcctttattactgtgcgagacaggtccgggggctcggatagttagaactaagtacggtaaaacgttccgggtaccgtactaaaacgaacgtaggttcgacgtccgtgggaccacgggaccctggtccaccgtcctcctcncgtcctccaccgacgggcccacgtccggtcccttccccgtcggccctacccctcccgtaccaacgcgccaccgtcggtcggggccacgcggccggccgtgggctcgccgtggacacgtacctaccttcccangtcnctcgtgcgccggtgtcggacacggcngatagnnncnnnnn

SEQ ID NO: 169050 - DNA, 549 bp, Homo sapiens
  misc_feature: GYAE6OF02HIHAN.4.72.G06.1.454.CMB.1.raw
  modified_base (370)..(370): a, c, t, g, unknown or other
  misc_feature (370)..(370): n is a, c, g, or t
  modified_base (510)..(510): a, c, t, g, unknown or other
  misc_feature (510)..(510): n is a, c, g, or t
  modified_base (538)..(538): a, c, t, g, unknown or other
  misc_feature (538)..(538): n is a, c, g, or t
  modified_base (542)..(549): a, c, t, g, unknown or other
  misc_feature (542)..(549): n is a, c, g, or t
tcagagcactgtagcacgaccggtgctcgatttagctacgactgcaagggaaagggaggcaccttcagtacgtttgatataaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggccgtttattactgtgcgagacatccggggggctcggatatgaactaatggaaaaagttccgggtaccgctaaacaacaggttcgagtcctggggccagggaaccctggtcaccgtcncctcagccctccaaccaagggccccagtccggtcttcccccgtggccaccctcctccaacgacgcacctcgtggggccacgacgccggccctgggcctgccctggtccaaggtctaccttcccacacgtcgctctacggngccgggctggacaaggccgcaatacggnagcnnnnnnnn

SEQ ID NO: 169051 - DNA, 727 bp, Homo sapiens
  misc_feature: GYAE6OF02FHLZ1.4.72.G06.1.454.CMB.1.raw
  modified_base (708)..(708): a, c, t, g, unknown or other
  misc_feature (708)..(708): n is a, c, g, or t
  modified_base (721)..(721): a, c, t, g, unknown or other
  misc_feature (721)..(721): n is a, c, g, or t
  modified_base (723)..(723): a, c, t, g, unknown or other
  misc_feature (723)..(723): n is a, c, g, or t
  modified_base (725)..(727): a, c, t, g, unknown or other
  misc_feature (725)..(727): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccagggcagactcacaattaccgcggacaagtccaagcgcacagcgtacatggactgaggagcctgagatctgaagacacggccgtttatactgtgcgagacagtccgggggctcggatacttggaactaataggaaaaacgtttccgggtaccgactaaaactaacgtacgggtttacgaaggttaccccgttggggacccgaacggggtaaaccccgttcggggtacccaaccccggttcctaccccgttacgtaacggccccttacccgaaccgaaaccgggggcccctaaacgttccggggttccctttaccccccgtgggacccaccccgttccctacccgaaccgacgtccctaacccgtccgttcgggggggacccaaccgaccgggcccgggtccccgtcggggcccgtcggtcccgttcgggtaccgaaaccgggtaacccgttacctttaccccgtacgtaacggttcgtacctccgttaggtacgtccggggtcttacgggccgaacggggtccgacgtaacgtacgngacgtcgacgtcncncnnn

SEQ ID NO: 169052 - DNA, 679 bp, Homo sapiens
  misc_feature: GYAE6OF02FXUCF.4.72.G06.1.454.CMB.1.raw
  modified_base (235)..(235): a, c, t, g, unknown or other
  misc_feature (235)..(235): n is a, c, g, or t
  modified_base (662)..(662): a, c, t, g, unknown or other
  misc_feature (662)..(662): n is a, c, g, or t
  modified_base (669)..(669): a, c, t, g, unknown or other
  misc_feature (669)..(669): n is a, c, g, or t
  modified_base (677)..(677): a, c, t, g, unknown or other
  misc_feature (677)..(677): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacagtggaactggaggancctggagatctaggaagacgacggccgttttattactgtgcgagacagtccggggggctcggatagttgaaactaagtaggtaaaaagttccgggtaccgactaaacaacgtaggttcgagttccgtaggggccgaagggaacccgtggtacacccgtctcctcgacgccctaccgacgaacgggccctagtccggtcccttcccccgtggtcccacccgttccctaccgaaacgcgaccctaacccgttcgacgggggcccaccgacggcccggacccgtcgggccgtcggtcccgtacgggtaccgaaacgggtcccttaaccgtttaccccgtacgaaccggttcggtccttaccggtacggtaacgggcccggggtacgttccgggacgtacggggacctacgaagttacggactacgcgtancgtaacncgtatacncg

SEQ ID NO: 169053 - DNA, 801 bp, Homo sapiens
  misc_feature: GYAE6OF02IU17I.4.72.G06.1.454.CMB.1.raw
  modified_base (781)..(781): a, c, t, g, unknown or other
  misc_feature (781)..(781): n is a, c, g, or t
  modified_base (799)..(799): a, c, t, g, unknown or other
  misc_feature (799)..(799): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacatgcacagaacgttccagggcagactcacaattaccgcggacaacgtccaagcgcacagcgtacagtaggaactggagacgctgagatcagaacgacgacggtccgtttagtactcggttagacggaagtacgacggttcccggggggacttcggtaagttacgttaacgtaacgtaaagttaagggtaaaaacggtttccccgggtaacccgtacgttaaaaccaaccggttaacgggttccgtaaccggttccggtacgggggtaaccctaaaccggggtaacccgttacggtacccgtaccgttaccgtcccgttacgctaccccggttccaaaccggtaacccggggtaccctaaccgttttcccgggttacccgtttccccccgtaccgggtaccctacccccgttacccgtaccgaacggtaaccgcccgtacccgttaccgggtacggggacccgtaaccggtaccggcccggtacccgggtccgggtacccgttccgggtaaccgtccggtaaccggtaaccgttacccgttaaccgttacccgtacgtaccggtacgttccgtacgtacggtcgggtacgggtccgtacggtacgaccggacgtaacggtcgtacgngacgtcagcgacgcgctncg

SEQ ID NO: 169054 - DNA, 762 bp, Homo sapiens
  misc_feature: GYAE6OF02IWLY9.4.72.G06.1.454.CMB.1.raw
  modified_base (751)..(751): a, c, t, g, unknown or other
  misc_feature (751)..(751): n is a, c, g, or t
  modified_base (755)..(755): a, c, t, g, unknown or other
  misc_feature (755)..(755): n is a, c, g, or t
  modified_base (759)..(759): a, c, t, g, unknown or other
  misc_feature (759)..(759): n is a, c, g, or t
tcagagcactgtagcacgaccggtgctcgatttagctacgactgcaagggaaagggaggcaccttcagtacgtttgatatcaattgggtgcgacaggcccctggacaagggctgagtggatgggaaggatcacccctaccctgcctatggcaaacaatgcacagaagttccagggcagactcacaattaccgcggacaagtccaagcgcacagcgtacatggaactggaggagcctgagatctagaacgacgaccggtaccgtttattacgtggtgacgagacgtacgtccccggggggcttacggattaacgttacggaaaacttaagttaagggtaaaacgggtttacccggggtaccgaaccgtaaaacgaacgtaggttacgtacggttccgtacgggggacccgtaaccggggtaacccgttcggtacccgtacccgttcctacccgttaccgacgtcccctaccgaaccgaaaccgggtccccgtacgttacccggtaccctttccccccgtcggtacccctaccccgttaccccgtaccgaaccgacgtcccacccgtcggtccggggtacaccggacggtcccgggtcccgtccggggtcccttcggccccgtttacggtaacccgaacgggttaacccttaaccctttaccccgtaacgcgttacggtacccgtcgtacggaccgggtccgggaccgtacgggtaccgtaacgggccggaacgtacgtacgacgctacgcgngtantacncag

SEQ ID NO: 169055 - DNA, 756 bp, Homo sapiens
  misc_feature: GYAE6OF02HQRN4.4.72.G06.1.454.CMB.1.raw
  modified_base (244)..(244): a, c, t, g, unknown or other
  misc_feature (244)..(244): n is a, c, g, or t
  modified_base (743)..(743): a, c, t, g, unknown or other
  misc_feature (743)..(743): n is a, c, g, or t
  modified_base (749)..(749): a, c, t, g, unknown or other
  misc_feature (749)..(749): n is a, c, g, or t
  modified_base (754)..(754): a, c, t, g, unknown or other
  misc_feature (754)..(754): n is a, c, g, or t
  modified_base (756)..(756): a, c, t, g, unknown or other
  misc_feature (756)..(756): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggagtgggaaggatccacccctaccctgccttagtggacaaacaatgcacagaagttccaggcagactcactaattaccgcggacaagtccgaagccgacacacgcgtacagtggaactggacggngccgtaggaagatcgaggaaacgaccgtacggtaccgttttaattacgtggttacgcggtagaaccgtacggtccggggggtaccgtcggtaattacgttagaaacgttaaagtaaggtaaaaacggtttccggaccgtaacgtaaaccgaacgtaacgggttaccgacgttaccggtacgggacccgtaacggggtacccgtacggtaccgacccgttcctccctacgaccgtccctacccaaccgaacgggccctaacgttcccggttcccgtttccccggtccgtccccgtaccgtccgtccctacccggaacggccgacccgccgtaccggacggacgtaccaccggtacgggcccggcccggtcgggtaccgtcggccgttacgggtacggtaaccggttccccttaccgttccccgtaactcgggttcccgtcgccgttgggaccggtccgggtccggaccggcggtaaccgggtacgacgtacgttcgcgtnaccgtncggtngn

SEQ ID NO: 169056 - DNA, 690 bp, Homo sapiens
  misc_feature: GYAE6OF02FNLY1.4.72.G06.1.454.CMB.1.raw
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
  modified_base (687)..(687): a, c, t, g, unknown or other
  misc_feature (687)..(687): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatcaccctaccctgcctatggcaaacaatgcacagaagttccaggcagactcacaacttaccgcggacaagtccaagcgcacagcgtacagtggaactgagagcctgagatctaggaagaccgacggtccgtttaatactgtgcganacgacgtcgggggctacggatgttagaactaagtaggaaaacgttccgggtaccgtactaaaacacgtacggtacgaggtccgtgggaccaacgggacctcggtcgaacccgtcncctacgacgccctacgaaccgaacgggtaccacggtccgtacccttcccccgtggaccctacccgtaccctacccgaacgtacgtccctacccgttcgtcgggtacgccacgacggacccggtcccgtcggggtcctccgggtccgttaccgggtacgtaaacccggtacctttacccgtttacccctaaccgtacggttaccgtccggttccgtagggtaccggtccggggtacttcccggggaccggtaacgggcccgaacgtaaccgtacggacgtcgacgtgtagccggtgngcg

SEQ ID NO: 169057 - DNA, 775 bp, Homo sapiens
  misc_feature: GYAE6OF02IZNFU.4.72.G06.1.454.CMB.1.raw
  modified_base (758)..(758): a, c, t, g, unknown or other
  misc_feature (758)..(758): n is a, c, g, or t
  modified_base (762)..(762): a, c, t, g, unknown or other
  misc_feature (762)..(762): n is a, c, g, or t
  modified_base (767)..(767): a, c, t, g, unknown or other
  misc_feature (767)..(767): n is a, c, g, or t
  modified_base (771)..(771): a, c, t, g, unknown or other
  misc_feature (771)..(771): n is a, c, g, or t
  modified_base (774)..(775): a, c, t, g, unknown or other
  misc_feature (774)..(775): n is a, c, g, or t
tcagagcactgtagcacgaccggtgctcgatttagctacgactgcaagggaagggaggcaccttcagtacgtttgatatcaattgggtgcgacaggcccctggacagggcttgagtggatgggagatcaccctacctgacctatacggacaaacaatgacacagaacgttccgagggcagactcaacaattaccggacggacagtaccaagcgacacagacgtacagtaggaactggaggacgccgtagacgtatacgtagaacgacgtaccggtaccgtttaattacgtaggtacgacgaagacgtacggtaccggggggtctacggtactagttacggtaactaaggttaggtaaaacggttccgggacctaccgtaaacacgtacggttacggtacgtaccggtacgggtaccgaagggtaccctaggtaccgtaccgtcctacccgtacaacgtaccctaccgaaccggtaacggacccctaacgttcccgggttacccctttaccccgggtcggtaccctaccccgtacccgtaacccgtaacggaccgtacccgtaccgttaccgggtaacgggggtaccaaccgggttaccgggaccccgggtaccggttccgggaccgttacccgggtacggttacggtaacgtaaccgggtaccctttaacccgttaccgtaacgtacggtacctaccgttaccggtacggaccgggtacgggtacgacggtacgtacgggaccgtcgaacgtgtacgngacncgtanacgnagnn

SEQ ID NO: 169058 - DNA, 745 bp, Homo sapiens
  misc_feature: GYAE6OF02JC4IQ.4.72.G06.1.454.CMB.1.raw
  modified_base (265)..(265): a, c, t, g, unknown or other
  misc_feature (265)..(265): n is a, c, g, or t
  modified_base (554)..(554): a, c, t, g, unknown or other
  misc_feature (554)..(554): n is a, c, g, or t
  modified_base (734)..(735): a, c, t, g, unknown or other
  misc_feature (734)..(735): n is a, c, g, or t
  modified_base (738)..(738): a, c, t, g, unknown or other
  misc_feature (738)..(738): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatccacccctaccctgcctatggacaaacaagtgcacgagtaacgttccagggccagacgtcaacaacgttaccggcggaactaaacggtcccaaaggcgccgaacagccgttaacactaggaacctggtacgganccgtagtagacttcgtaggaaacgaccgtaccggtaccgttttaacttacgtagttcggacgacgacgtaaccgggtccgggggtcctacgggtaacttacgttaagtaacgttaagaaggttaaaaaccggttcccggtaccgactaaaacctacgtacggttacgacgtcccgggtgggtaacccgaccgggtaacctcgggtaccaccccggttactcccgtaccgtacggccccttaccgaacccggtacggtaccccgtagttacccggttccccgtaccccgnggtcccgtcccgtcgcccgtccgacggaccgtcccgtaaccgtcggaacgtaccgaccgacggtaccgcccggtaccgtcgtccgtcgaccgttacgacgtaccgtaccttacccgtccctacgtacgtcgtacgtaccgtcgggacgtccgcgtcgacggacgcgactgtacgcgtcgnngtnacgtgac

SEQ ID NO: 169059 - DNA, 833 bp, Homo sapiens
  misc_feature: GYAE6OF02F38Q9.4.72.G06.1.454.CMB.1.raw
  modified_base (216)..(216): a, c, t, g, unknown or other
  misc_feature (216)..(216): n is a, c, g, or t
  modified_base (820)..(820): a, c, t, g, unknown or other
  misc_feature (820)..(820): n is a, c, g, or t
  modified_base (827)..(827): a, c, t, g, unknown or other
  misc_feature (827)..(827): n is a, c, g, or t
  modified_base (831)..(832): a, c, t, g, unknown or other
  misc_feature (831)..(832): n is a, c, g, or t
tcagagcactgtagcacgaccggtgctcgatttagctacgactgcaagggaaagggaggcaccttcagtacgtttgatatcaattgggtgcgacaggcccctggacaagggcttgagtggatgggaaggatccaccctaccctgcctatggacaaacaatgacacagaagttccagggcagactcacaattccggacgacaagtccaagcgacacngcgtacatggaactggaggacgcctaggagtactacgtaggaaacgtaccgaccggttacccgttttaagttaaccgttggttcggaccggaagtaccggtaacgggtcccgggggggtacgtacggtagttaagtttacggtaaacgttaaaacggttaagggtaaaaaccgggtttacccgggtacccgtaacttaaaaccgaacggttaacggggttacggtacgtacccggtacgggggacccgtaaccggggaccttcggggtaccccgtaaccgttccttaccccgtccgaccgtaccccgtaccaaaccgtaacccggggcctacccggttcccgggttaccctttccccccgggtcggtaccccgtacccccttcccgtaacccgaaacggtacccgtacctaacccggttccggtaccggggacccgtacggtaccggggcccggtacccggtcgggttcccgccggtcccgtaccgggtacggtaaccggttacccgttaaccgtttcccgtacgtacgttccgaccgttacgaacggtcgggaccgggtcgtacgggtaccgaacgggccgtacgtaacggtacgtgtaccgngtcgcgncgtnnc

SEQ ID NO: 169060 - DNA, 493 bp, Homo sapiens
  misc_feature: GYAE6OF01DN3F4.37.11.A11.1.454.CMB.1.raw
  modified_base (487)..(487): a, c, t, g, unknown or other
  misc_feature (487)..(487): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtatctgggcgagagggcctccatcaactgcaagtccagccagactgttttatacagctccaacaataagaactacttagcttggtatcagcagaaaccagggcagcctcctaaactgctcatttactgggcatctaccgggagtccggggtccctgaccgattcagtggcagcggtctgggacagatttcactctcaccatcaacagcctgcaggctgaggatgtggcgatttatactgtcagcagtattataatactcctcgacgttcggaccaagggaccaaggtgaaatcaaagactgtgctgcacatctgtcttcattcttcccgcntctacg

SEQ ID NO: 169061 - DNA, 497 bp, Homo sapiens
  misc_feature: GYAE6OF01DFFNJ.37.11.A11.1.454.CMB.1.raw
  modified_base (361)..(361): a, c, t, g, unknown or other
  misc_feature (361)..(361): n is a, c, g, or t
  modified_base (460)..(460): a, c, t, g, unknown or other
  misc_feature (460)..(460): n is a, c, g, or t
  modified_base (492)..(492): a, c, t, g, unknown or other
  misc_feature (492)..(492): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggagtccggggtcctgaccgattcagtggcagcgggtctggacagtattcactctcaccatcaacngccagcaggctgaggatgtggcgtatttattactgtcagcagtattataatactcctcgacgttcggaccaagggaccaaggtgaaatcaaacgactgnggctgcacatctgtcttcacttcttcccgctntctag

SEQ ID NO: 169062 - DNA, 512 bp, Homo sapiens
  misc_feature: GYAE6OF01AD6OW.37.11.A11.1.454.CMB.1.raw
  modified_base (503)..(503): a, c, t, g, unknown or other
  misc_feature (503)..(503): n is a, c, g, or t
tcagtagtgtagatcacgaccggtgctcgatttagctacgactgcaaggggcagcaacgatggtgttgcagacccaggtcttcatttctctcgttgctctggatcgtctggtgcctacggggacaccgtgatgacccagtctccagactccctggctgtgtctcctgggcgagaggcctcatcaactgcaagtccagccagactgttttatacagctccaacaataagaactacttagcttggtatcagcagaaaccaggacagcctacctaaactgctcatttactggcatctacccggagtccgggtcctgaccgattcagtggcagcgggtctgggacagatttcactctcacatcaacagcctgcagctgagatgtggcgtatttatactgtctagtcagtattataatactacctcgtacgttcggaccgtaagggaccaaggtagaaactcgaaacgtactagtagctgccaccgatcctgtcttctattcctcccnctctctacg

SEQ ID NO: 169063 - DNA, 492 bp, Homo sapiens
  misc_feature: GYAE6OF01D4XO8.37.11.A11.1.454.CMB.1.raw
  modified_base (487)..(487): a, c, t, g, unknown or other
  misc_feature (487)..(487): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccgggtccctgaccgattcagtggcagcgggtctggacagatttcactctcaccatcaacagcctgcaggctgaggatgtgcgtatttatactgtcagcagtattataatactcctcgacgttcggccaagggaccaaggtgaaatacaaacgactgtgctgcacatctgtcttcatctcccgctntctag

SEQ ID NO: 169064 - DNA, 495 bp, Homo sapiens
  misc_feature: GYAE6OF01BBITX.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaaactgctcatttactgggcatctacccgggagtccggggtccctgaccgattcagtggcagcggtctgggacagatttcactctcacatcaaacagcctgcaggctgaggatgtgcgatttatactgtcagcagtattataatactcctcgacgttcgccaagggaccaaggtgaaatcaaacgaactgtggctgcacatctgtcttcatcttcccgcctatctag

SEQ ID NO: 169065 - DNA, 523 bp, Homo sapiens
  misc_feature: GYAE6OF01C9X9K.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctaccaacaataagaactacttagcttggtatcagcagaaaccagggcagcctacctaaactgctcatttactgggcatctacccgggagtcccggggtcctgaccgattcagtggcaggcgggtctgggacagattcactctcacatcaacagcctgcaggctgaggatggtggcgtattttatactgtcagctagtattataatactcctcgtacgttcggacctaaagggaccaaggtagaaatcgaaaacgtactgtacggactgaccactatccttagtccttcacttcccttcccgctatctaacg

SEQ ID NO: 169066 - DNA, 495 bp, Homo sapiens
  misc_feature: GYAE6OF01EE89X.37.11.A11.1.454.CMB.1.raw
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcacatcaacagcctgcaggctgaggatgtggcgtatttattactgtcagcagtattataatactcctcgacgttcggaccaagggaccaaggtgaaatcaaacgactgtgctgcaccatcngtctcatcttcccgcntctag

SEQ ID NO: 169067 - DNA, 519 bp, Homo sapiens
  misc_feature: GYAE6OF01DBVHF.37.11.A11.1.454.CMB.1.raw
  modified_base (286)..(286): a, c, t, g, unknown or other
  misc_feature (286)..(286): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcagctgcaagtccagccagactgttttatacagctccaacaataaagaactacttagcttggtaatcagcagaaaccagggcagcctacctaaactgctcatttacnggcatctacccgggagtccggggtccctgaccgattcagtggcagcgggtctgggacagatttcactctcacatcaacngcctgcaggctgagatgtgcgtatttattcngtcagcagttatataatacctctccgacgttcggacctaagggacctaaggtaggaaactacgaaaacgtacgtagtcggctacgacacctattctgtccttcacttccttcccgcagttccg

SEQ ID NO: 169068 - DNA, 497 bp, Homo sapiens
  misc_feature: GYAE6OF01CN5YJ.37.11.A11.1.454.CMB.1.raw
  modified_base (367)..(367): a, c, t, g, unknown or other
  misc_feature (367)..(367): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctggacagattcactctcacatcaacagcctgcnggctgagatgtggctatttatactgtcagcagtattataatactccgtcgacgttcggccaaagggaccaaggtgaaatcgaaacgtaactgtgctgacacatctgtcttctactctacccncntctacg

SEQ ID NO: 169069 - DNA, 482 bp, Homo sapiens
  misc_feature: GYAE6OF01AR5IT.37.11.A11.1.454.CMB.1.raw
  modified_base (477)..(477): a, c, t, g, unknown or other
  misc_feature (477)..(477): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagattcactctcacatcaacagcctgcaggctgaggatgtggctatttatactgtcagcagtatatatactctcgacgttcgcaagggaccaaggtgaaatcaaacgatgtgctgcacatctgtcttcatctccgcntctag

SEQ ID NO: 169070 - DNA, 495 bp, Homo sapiens
  misc_feature: GYAE6OF01DYDPT.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggagtccgggtcctgaccgattcagtggcagcggtctgggacagattcactctcaccatcaacagcctgcaggctgagatgtggcgtatttatactgtcagcagtattataatactcctcgacgttcggaccaagggacaaggtgaaatcaaacgactgtcggctgcacatctgtcttactactccttcccgcatctacg

SEQ ID NO: 169071 - DNA, 502 bp, Homo sapiens
  misc_feature: GYAE6OF01EGLT3.37.11.A11.1.454.CMB.1.raw
  modified_base (362)..(362): a, c, t, g, unknown or other
  misc_feature (362)..(362): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagattcactctcaccatcaacngcctgcaggctgaggatgtggcgtatttatactgtcagcagtattataatacctctccgacgttcggaccaagggaccaaggtaggaaatcgaaacgaactgtaggctgcaccatctgtctcatcttcccgctatctacg

SEQ ID NO: 169072 - DNA, 509 bp, Homo sapiens
  misc_feature: GYAE6OF01C36VH.37.11.A11.1.454.CMB.1.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccngggcagcctcctaaactgctcatttacngggcatctaccgggagtccgggtcctgaccgattcagtggcagcggtctggacagatttcactctcaccatcaacagcctgcaggctgagatgtgcgtatttatactgtcagctagtattataatctccgtcgacgttcggccaagggtaccaaggtcgaaatcgaaaacgtactgnggctagctaccattccnggttcctctacttccttacccgcctagtctacg

SEQ ID NO: 169073 - DNA, 500 bp, Homo sapiens
  misc_feature: GYAE6OF01BL0I2.37.11.A11.1.454.CMB.1.raw
  modified_base (363)..(363): a, c, t, g, unknown or other
  misc_feature (363)..(363): n is a, c, g, or t
  modified_base (459)..(459): a, c, t, g, unknown or other
  misc_feature (459)..(459): n is a, c, g, or t
  modified_base (494)..(494): a, c, t, g, unknown or other
  misc_feature (494)..(494): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcggtctgggacagatttcactctcacatacaacngcctgcaggctgaggatggtggcgtatttatactgtcagcagtatataatactcctcgacgttcggccaagggaccaaggtgaatcaaacgactgngctgcaccatctgtcttacacttccttacccgctntctacg

SEQ ID NO: 169074 - DNA, 493 bp, Homo sapiens
  misc_feature: GYAE6OF01ARCCB.37.11.A11.1.454.CMB.1.raw
  modified_base (487)..(487): a, c, t, g, unknown or other
  misc_feature (487)..(487): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccaggcagcctcctaaactgctcatttactgggcatctacccgggagtccgggtccctgaccgatcagtggcagcgggtctggacagattcactctcacatcaacagcctgcaggctgagatgtggctatttatactgtcagctagtattatatctcctcgacgtcgccaagggaccaggtacgaatcaaacgactgtcggctgcacatctgtacttcgtactccttacccgctntctacg

SEQ ID NO: 169075 - DNA, 486 bp, Homo sapiens
  misc_feature: GYAE6OF01BT4KF.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctctaaactgctcatttactgggcatctacccggagtccgggtcctgaccgattcagtggcagcggtctggacagattcactctcacatcaacagcctgcaggctgaggatgtgcgtatttatactgtcagcagtatataatactcctcgacgttcgccaagggaccaaggtgaaatacaaacgaactgtagctgcacatctgtctcgactcttcccgcatctag

SEQ ID NO: 169076 - DNA, 543 bp, Homo sapiens
  misc_feature: GYAE6OF01CVSDN.37.11.A11.1.454.CMB.1.raw
  modified_base (251)..(251): a, c, t, g, unknown or other
  misc_feature (251)..(251): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggccaccatcaactgcaagtccagccagacttcttttgtcagcgtcgaacaataagaacttacttgctttaggaaccaanagaaagcaggacagctacctaagttgctcatttactcggcatcccgacccggcacgtcccggggtcctcgaccgtattcgagcggcaggcgggtcgtggacagtacttcactctcacatcacgcacgcctgcaggctagaacgatggtcgtctagttttacttcgtgtctgctagttagttcggtactccgtcggtactttcggcgacggaggaccgaagggtggagactcaagcgtaagtggtcgctcgccaccgtattccgtacgttcttaccactttcccgtcccgtac

SEQ ID NO: 169077 - DNA, 500 bp, Homo sapiens
  misc_feature: GYAE6OF01A6TD4.37.11.A11.1.454.CMB.1.raw
tcagtagtgtagatcacgaccggtgctcgatttagctacgactgcaggggcagcaagatggtgttgaagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgtatttatactgtcagctagtattataatactcctccgacgttcggccaagggaccaaggtggaaatcgaaacgactgtgctgcacatctgtcttcatctcccgcatctgtaac

SEQ ID NO: 169078 - DNA, 489 bp, Homo sapiens
  misc_feature: GYAE6OF01CSKB9.37.11.A11.1.454.CMB.1.raw
  modified_base (457)..(457): a, c, t, g, unknown or other
  misc_feature (457)..(457): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctcaacaataagaactacttagcttggtatcagcagaaaccagggcagcctcctaaactgctcatttactgggcatctacccgggagtccggggtccctgaccgattcagtggcagcgggtctggacagattcactctcaccatcaacagcctgcaggctgagatgtggcgatttatactgtcagcagtattataatactcctccgacgttcggccaaagggccaaggtgaaatcaaacgactgngctgcacatctgtcttcatctccncntctacg

SEQ ID NO: 169079 - DNA, 492 bp, Homo sapiens
  misc_feature: GYAE6OF01BJQZD.37.11.A11.1.454.CMB.1.raw
  modified_base (364)..(364): a, c, t, g, unknown or other
  misc_feature (364)..(364): n is a, c, g, or t
  modified_base (484)..(484): a, c, t, g, unknown or other
  misc_feature (484)..(484): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacngcctgcaggctgaggatgtggcgatttattactgtcagcagtattatgttactcctcactagtttggccgtagggaccaagctggagatcgcacgaactgtggctgcacatctgtcttcntcctcccg

SEQ ID NO: 169080 - DNA, 616 bp, Homo sapiens
  misc_feature: GYAE6OF01BH0UY.37.11.A11.1.454.CMB.1.raw
tcagtagtgtagatcacgaccggtgctcgatttagctacgactgcaggggcaggcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactggcatctaccggagtccgggtacctgaccgattcagtggcagcggtctggacagatttcgactctcaccgatcaacacgcctagacgacgcgtacggaagtgtggtacggtacgttaatttacgttagtacgtacgacgtacgttaagtttaattaacttaacttacccttccgtaacccggttaccggttaccggaaccggtaaaccgggtaacggtaagggttaagtaacgtaaccggaaacgtacgtaggtacggtacgtcggacctaactcgttacgtacgttcctaccttaccgttcccgttaccccgtactaccgttcgtaaaccg

SEQ ID NO: 169081 - DNA, 564 bp, Homo sapiens
  misc_feature: GYAE6OF01CQ5EY.37.11.A11.1.454.CMB.1.raw
  modified_base (282)..(282): a, c, t, g, unknown or other
  misc_feature (282)..(282): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctaccaacaataagaactactagcttggtatcagcaagaaaccaggcagcctactaaactgctcatttacnggcatcgtaccggagtccgggtcctgaccgtattcagtggcaggcggtctggacagtattcactctcacatcaacacgctgcaggctagaggatgtaggcgtaatttatactgtacagctagtattataactactacctacgtacgttacggaccgtaaagggaccctaaaggtacggaaactacgaaaacggtaacttggtacggactacggacctaacccgtattccgttacggttacctttcctaacgtttcccgttaccccgactacttccgttaacg

SEQ ID NO: 169082 - DNA, 495 bp, Homo sapiens
  misc_feature: GYAE6OF01CHRF1.37.11.A11.1.454.CMB.1.raw
  modified_base (489)..(489): a, c, t, g, unknown or other
  misc_feature (489)..(489): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggagtccggggtcctgaccgattcagtggcagcgggtctgggacagattcactctcaccatcaacagcctgcaggctgaggatgtggctatttatactgtcagcagtattataatactcctcgacgttcggaccaagggaccaaggtcgaaatcgaaaacgactgtgctgcacatctgtcttcactctcccgcntctacg

SEQ ID NO: 169083 - DNA, 491 bp, Homo sapiens
  misc_feature: GYAE6OF01DBXEZ.37.11.A11.1.454.CMB.1.raw
  modified_base (460)..(460): a, c, t, g, unknown or other
  misc_feature (460)..(460): n is a, c, g, or t
  modified_base (486)..(486): a, c, t, g, unknown or other
  misc_feature (486)..(486): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctctaaaactgctcatttactgggcatctaccgggagtccggggtccctgaccgattcagtggcagcgggtctgggacagatttcactctcaccatcaacagcctgcaggctgaggatgtggcgatttattactgtcagcagtattataatactcctcgacgttcggccaagggccaaggtgaaatcaaacgaactgnggctgcacatctgtctcatctccgcntctag

SEQ ID NO: 169084 - DNA, 690 bp, Homo sapiens
  misc_feature: GYAE6OF01B0OLQ.37.11.A11.1.454.CMB.1.raw
  modified_base (644)..(644): a, c, t, g, unknown or other
  misc_feature (644)..(644): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagccctcctaaaactcgctacttatttacgtggactactcccggtaacccggggtacgggttccccggggtacccgtacggaaccgttacgttacgtaggtcggacgacgggtcgggtcggtacggacgagttacttcctaccgtcctaccaacctactaaccaaacgacgtcccgtcgacgacgggtcgtagggaacggtagttcgggtacgggacgtttaattttaacgttacgttcgtacgacgtactaagtttaatttaacttaaaccttacccttccccgttacggtacccggttacccggaacggtaaaccgggtaaccggtaagggtaaagtaaacctaacgaaaaccgtacgtaggtcgtacgtcgacccaaccgtnttccgtctttccgtactaccttccctacccgacttactcgtaaacg

SEQ ID NO: 169085 - DNA, 499 bp, Homo sapiens
  misc_feature: GYAE6OF01AZ9KZ.37.11.A11.1.454.CMB.1.raw
  modified_base (477)..(477): a, c, t, g, unknown or other
  misc_feature (477)..(477): n is a, c, g, or t
  modified_base (494)..(494): a, c, t, g, unknown or other
  misc_feature (494)..(494): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttattactgtcagcagtatataatactcctccgacgttcggccaaggggaccaaggtggaaatcaaaacgaactgtgctgcaccatcngtcttcatcttcccgcntctag

SEQ ID NO: 169086 - DNA, 484 bp, Homo sapiens
  misc_feature: GYAE6OF01CDZ84.37.11.A11.1.454.CMB.1.raw
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggagtccgggtcctgaccgattcagtggcagcgggtctggacagattcactctcaccatcaacagcctgcaggctgaggatgtggctatttatactgtcagcagtattataatactcctcgacgttcggccaagggccaaggtgaaatcaaacgactgtgctgcacatctgtctcatctccncntctag

SEQ ID NO: 169087 - DNA, 599 bp, Homo sapiens
  misc_feature: GYAE6OF01CWUBU.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcaagaaaccagggcagcctacctaaactgctcatttacgtgggctacgtccgtacccggggacgttcccggggtccctacggaccgtattcgaggtggcgacggtcgggtcgtagggactagtacttcactctacaccatacaaacgagccctgacaggctggaggtcgtggtggacgttaatttacgttactgtacagctaagtattaactaactactccgtaccgtacggttcggaccgaagggtaccaaaggtacgaaactacgaaaacgacgttgtacgggctacggaccaaccctattcctcggttacctttacgtacctccgttaccccgcctaagtccttaaacg

SEQ ID NO: 169088 - DNA, 495 bp, Homo sapiens
  misc_feature: GYAE6OF01BZP55.37.11.A11.1.454.CMB.1.raw
  modified_base (362)..(362): a, c, t, g, unknown or other
  misc_feature (362)..(362): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagattcactctcaccatcaacngcctgcaggctgaggatgtggcgatttattactgtcagcagtattataatactcctccgacgttcggccaagggaccaaggtgaaatcaaacgactgtggctgcacatctntcttcatcttcccgcntctacg

SEQ ID NO: 169089 - DNA, 498 bp, Homo sapiens
  misc_feature: GYAE6OF01D1M0M.37.11.A11.1.454.CMB.1.raw
  modified_base (208)..(208): a, c, t, g, unknown or other
  misc_feature (208)..(208): n is a, c, g, or t
  modified_base (331)..(331): a, c, t, g, unknown or other
  misc_feature (331)..(331): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (493)..(493): a, c, t, g, unknown or other
  misc_feature (493)..(493): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctacctaaactgctcatttactgggcatccgtacccgggagtcccggggtcctgaccgattcagtggcngcgggtctgggacagtattcactctcaccatcaacagcctgacaggctgaggatgtggctatttatactgtcagcagtattataatactcctcgacgttcggaccaagggccaaggtgaaatcaaagactgngctgccacntcngtctcacttcctcccgcntctag

SEQ ID NO: 169090 - DNA, 498 bp, Homo sapiens
  misc_feature: GYAE6OF01BZDLA.37.11.A11.1.454.CMB.1.raw
  modified_base (492)..(492): a, c, t, g, unknown or other
  misc_feature (492)..(492): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgtatttattactgtcagcagtattataatactcctcgacgttcggccaagggaccaaggtgaatcgaaacgactgtgctgcacatctgtcttcactcttcccgctntctacg

SEQ ID NO: 169091 - DNA, 503 bp, Homo sapiens
  misc_feature: GYAE6OF01CYNOT.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtcccggggtccctgaccgattcagtggcagcggtctggacagatttcactctcaccatcaacagcctgcaggctgaggatgtggcgtatttattactgtcagcagtattataatactcctcgacgttcggccaagggaccaaggtagaaatcaaaacgactgtggctgccacatctgtcttcatccttcccgcctatctaacg

SEQ ID NO: 169092 - DNA, 499 bp, Homo sapiens
  misc_feature: GYAE6OF01BXPCA.37.11.A11.1.454.CMB.1.raw
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagattcactctcaccatcaacagcctgcaggctgacggatgtggcgtatttatactgtcagcagtattataatactcctcgacgttcggaccaagggaccaaggtaggaatacaaacgactgngctgcacatcngtcttcacttctcccgctntctacg

SEQ ID NO: 169093 - DNA, 511 bp, Homo sapiens
  misc_feature: GYAE6OF01EFCZ7.37.11.A11.1.454.CMB.1.raw
  modified_base (287)..(287): a, c, t, g, unknown or other
  misc_feature (287)..(287): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaaacaataagaactacttagcttggtatcagcaagaaaccagggcagcctacctaaactgctcatttacngggcatcgtacccgggagtcccggggtcctgaccgattcagtggcaggcgggtctgggacagtatttcactctcacatcaacagcctgcagctgagatgtggcgtatttatctgtcagctagtattatatactcctcgacgttacgaccaagggacctaaggtagaaactcgaaacgtatcggtagctagctacattctgtcttcactcctacccgctatctag

SEQ ID NO: 169094 - DNA, 492 bp, Homo sapiens
  misc_feature: GYAE6OF01C3UP3.37.11.A11.1.454.CMB.1.raw
  modified_base (458)..(458): a, c, t, g, unknown or other
  misc_feature (458)..(458): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagatttcactctcaccatcaacagcctgcaggctgaggatgtggctatttatactgtcagcagtattataatactcctcgacgttcggccaagggccaaggtgaaatcaaacgactgngctgcacatctgtcttcatcctcccncntctacg

SEQ ID NO: 169095 - DNA, 474 bp, Homo sapiens
  misc_feature: GYAE6OF01DH0QV.37.11.A11.1.454.CMB.1.raw
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (454)..(454): a, c, t, g, unknown or other
  misc_feature (454)..(454): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctcaacaataagaactacttagcttggtatcagcagaaaccagggcagcctcctaaactgctcatttactgggcatctacccgggatccgggtcctgaccgattcagtgcagcggtctggacagnttcactctcacatcaacngcctgcagctgaggatgtgcgtatttagtgctgtcagctaagtattataatctcctcgagttcgacaaggaccaagtgaatcaaacgatgtgctgacacntctgtctcactctccncntc

SEQ ID NO: 169096 - DNA, 491 bp, Homo sapiens
  misc_feature: GYAE6OF01DFNJ6.37.11.A11.1.454.CMB.1.raw
  modified_base (472)..(472): a, c, t, g, unknown or other
  misc_feature (472)..(472): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctcctaaactgctcatttactgggcatctacccgggagtccggggtccctgaccgattcagtgcagcgggtctggacagattcactctcaccatcaacagcctgcaggctgaggatgtggcgtatttatactgtcagcagtattataatactcctcgacgttcggaccgaagggaccaaggtgaaatcaaagactgtgctgcacatctntcttcatctccgcatctag

SEQ ID NO: 169097 - DNA, 671 bp, Homo sapiens
  misc_feature: GYAE6OF01B2WXN.37.11.A11.1.454.CMB.1.raw
  modified_base (393)..(393): a, c, t, g, unknown or other
  misc_feature (393)..(393): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctcaacaataagaactacttagctttggtatcagcaagaaaccagggcagcctacctaaactgctcatttacctgggcatccgtacccgggagtcccggggtccctgaccgattcgagtggcaggcgggtctgggacagtatttcactctcacatacaacagccctgcaggctggaaggtntggtggtacttaattttacttacgtgtaccagtactaagtttaacttaattaaactaccgttacccgtaccggttaccggtttaccggaacccggtaaacggggtaacccgtaaaggggttacgtaaaaccttaaccggaaaaaccgtaacggttacggttacggtacccgttacggaacccttaacccgtacgtttacccgttacggtttacccctttaccgtaacccgttttcccccgttaccccccggtacctaaaccgtttccgttaaaaccgg

SEQ ID NO: 169098 - DNA, 495 bp, Homo sapiens
  misc_feature: GYAE6OF01DQT56.37.11.A11.1.454.CMB.1.raw
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctcatttactgggcatcgtaccgggagtccggggtcctgaccgattcagtggcagcggtctgggacagatttcactctcaccatcaacagcctgcaggctgaggatgtggctatttatactgtcagcagtattataatcctcctacgacgttcggaccaagggtaccaaggtgaaatcaaagactgngncgcacatcngtctcactctccgctntctacg

SEQ ID NO: 169099 - DNA, 529 bp, Homo sapiens
  misc_feature: GYAE6OF01BP3F5.37.11.A11.1.454.CMB.1.raw
  modified_base (208)..(208): a, c, t, g, unknown or other
  misc_feature (208)..(208): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctactaaactgctcatttactgggcatcgtacccgggagtccgggtcctgaccgattcagtggcaggcgggtctgggactagactttcactctcaccatacaacagcctgcagctgagatgngctatttatactgtnagtctagtaattataacttactcctcgacgtttcggacccgaaagggtaccaaagggtggaaatccgaaggacaacgttggnggtacncggacacctatcctagtacttcacttccttccccgctattcg

SEQ ID NO: 169100 - DNA, 502 bp, Homo sapiens
  misc_feature: GYAE6OF01C3UVL.37.11.A11.1.454.CMB.1.raw
  modified_base (286)..(286): a, c, t, g, unknown or other
  misc_feature (286)..(286): n is a, c, g, or t
  modified_base (479)..(479): a, c, t, g, unknown or other
  misc_feature (479)..(479): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctcattttacngggcatccgtaccggggagtcccggggtcctgaccgattcagtggcagcgggtctgggacagatttcactctcaccatcaacagcctgcagctgaggatgtggcgtatttattactgtcagtctagtattataatctcctcgacgttcgaccaagggtccaaggtagaaatcaaacgactgcgctgcacatcngtctctctcctccnctntctacg

SEQ ID NO: 169101 - DNA, 500 bp, Homo sapiens
  misc_feature: GYAE6OF01DXNQP.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctactaaactgctcatttacngggcatcgtacccgggagtccggggtcctgaccgattcagtggcagcgggtctggacagtattcactctcaccatcaacagcctgcaggctgaggatgtggctatttatactgtcagtcagttattataatactcctcgacgttcgacaagggaccaaggtgaaatcgaaacgtactgtcgctgcacatctgtcttcacttccttcccgctatctag

SEQ ID NO: 169102 - DNA, 489 bp, Homo sapiens
  misc_feature: GYAE6OF01CXC5E.37.11.A11.1.454.CMB.1.raw
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccaggcagcctcctaaactgctcatttactggcatctaccggagtccgggtcctgaccgattcagtggcagcgggtctggacagatttcactctcacatcaacagcctgcaggctgaggatgtggcgatttatactgtcagcagtattataatactcctcgacgttcggccaaagggaccaaaggtggaaatcaaacgaactgtgctgcacatctgtcttcatcttccgcntntacg

SEQ ID NO: 169103 - DNA, 494 bp, Homo sapiens
  misc_feature: GYAE6OF01BS7IZ.37.11.A11.1.454.CMB.1.raw
  modified_base (208)..(208): a, c, t, g, unknown or other
  misc_feature (208)..(208): n is a, c, g, or t
  modified_base (334)..(334): a, c, t, g, unknown or other
  misc_feature (334)..(334): n is a, c, g, or t
  modified_base (488)..(488): a, c, t, g, unknown or other
  misc_feature (488)..(488): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccggggtcctgaccgattcagtggcagcgggtntgggacagattcactctcaccatcaacagcctgcaggctgaggatgtggctatttatactgtcagcagtattataatactcctcgacgttcggccaagggaccaaggtgaaatcaaacgatgtgctgcacatctgtctctactcttcccgcctntctacg

SEQ ID NO: 169104 - DNA, 501 bp, Homo sapiens
  misc_feature: GYAE6OF01DTQFF.37.11.A11.1.454.CMB.1.raw
  modified_base (496)..(496): a, c, t, g, unknown or other
  misc_feature (496)..(496): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtcccggggtccctgaccgattcagtggcagcgggtctgggacagatttcactctcaccatcaacagcctgcaggctgaggatgtggcgtatttattactgtcagcagtattataatactcctccgacgttcggccaagggaccaaggtgaaactcaaacgaactgtgctggcacatctgtctcactctcccgcctntctag

SEQ ID NO: 169105 - DNA, 533 bp, Homo sapiens
  misc_feature: GYAE6OF01E08CK.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctacctaaactgctcatttacngggcatccgtacccggggagtcccggggtccctgaccgtattcgagtggcaggcgggtctgggacagtatttcactctcaccatcaacagcctgcaggctgaggatggtggcgtatttatactgacagctagttattaataactacctcctcgtacgttcggaccgaagggtaccaagggtgaaactacgaaacgtactgtcggctgccaaccattctgtcttactacttcccttacccgcctatctaag

SEQ ID NO: 169106 - DNA, 493 bp, Homo sapiens
  misc_feature: GYAE6OF01CEA0X.37.11.A11.1.454.CMB.1.raw
  modified_base (378)..(378): a, c, t, g, unknown or other
  misc_feature (378)..(378): n is a, c, g, or t
  modified_base (487)..(487): a, c, t, g, unknown or other
  misc_feature (487)..(487): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggagtccggggtccctgaccgattcagtggcagcgggtctgggacagattcactctcaccatcaacagcctgcaggctgaggntgtggcgtatttatactgtcagctagtattataatctcctcgacgttcgccaagggtaccaaggtgaaatcaaacgactgtggctgcacatctgtcttcatcctccgcntctacg

SEQ ID NO: 169107 - DNA, 525 bp, Homo sapiens
  misc_feature: GYAE6OF01C9SCX.37.11.A11.1.454.CMB.1.raw
  modified_base (382)..(382): a, c, t, g, unknown or other
  misc_feature (382)..(382): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctaccaacaataagaactacttagcttggtatcagcaagaaaccagggcagcctacctaaactgctcatttactgggcatcgtacccgggagtcccggggtcctgaccgattcagtggcgagcggtctggacagtattcactctcacatcaacagcctgcagctgagatgngctatttatactgtcagctagtattataactactcctacgtacgttcggaccgtaagggtaccaagggtacgaaatccgaaaacgtaacgtgtacggtcacgtccacagttctcgtcttcacttcctacccgctattcgtacg

SEQ ID NO: 169108 - DNA, 565 bp, Homo sapiens
  misc_feature: GYAE6OF01D3LV2.37.11.A11.1.454.CMB.1.raw
  modified_base (290)..(290): a, c, t, g, unknown or other
  misc_feature (290)..(290): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctccagactccctggctgtgtctctgggcgagagggcctccatcaactgcaagtccagccagactgttttatacagctaccaaacaataagaactacttagcttaggtatcagcaagaaaccagggcagcctacctaaactgactactatttacngggcagtccgtacccgggagtcccgggtcctgaccgattcagtggcagcgggtctggacagtattcactctcacanacaacngcctgcaggctgagatgtaggctattattactgtcagtactagttaacttaataactacctcctaccggtacgttacggacccgaaagggtaaccgtaagggtacggaaataccgaaacgtaacgtcggtacgtaccgtagacctaactatccgtagttcctactacttacccttccccgactatcgtaaacg

SEQ ID NO: 169109 - DNA, 533 bp, Homo sapiens
  misc_feature: GYAE6OF01CLDGT.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccagggcagcctactaaactgctcatttactgggcatcgtacccgggagtccgggtcctgaccgattcagtggcagcggtctggacagtatttcactctcaccatcaacagcctgcaggctggaggatggtgacgtatttatactgtcagctagtattataactctccgtccgtaacgttccggaccgtaagggacctaaaggtagaaactacgaaaacgtactggtgtactgacctaacatcctagtcttactacttaccttcccgacctgtcgtaacg

SEQ ID NO: 169110 - DNA, 638 bp, Homo sapiens
  misc_feature: GYAE6OF01EHN2V.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaaacaataagaactacttagcttggtatcagcaagaaaccgaggcacgcctacctaaactgctcatttactgggcacgtccgtacccgggagtcccggggtccctggaccgtattcaggtggcaggcgggtcgtgggacagtatttcactctacaccataccaacacgcctgcaggctggaggatggtggacgttatttattactgtcagtctaagttattaagtaacttaccttcccgtaccggtacggtttaccggacccgtaaaggggtaacccgtaaagggttacggaaaactacccgtaaaaaccggaacgtttggtacggtaccgttacggtacctaacccgtaacgttccgttacggttaccctttaccgtaactttccccgttacccccggacttaaccgttccgttaaacg

SEQ ID NO: 169111 - DNA, 504 bp, Homo sapiens
  misc_feature: GYAE6OF01D3846.37.11.A11.1.454.CMB.1.raw
  modified_base (496)..(496): a, c, t, g, unknown or other
  misc_feature (496)..(496): n is a, c, g, or t
tcagtagtgtagatcacgaccggtgctcgatttagctacgactgcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagactcttttgttcagcgtcgacaataagaactactttgcttggtaccaacagaaagcaggacagcctcctaagttgctcatttactcggcatccacccgggcatccggggtccctgaccgattcagcggcagcgggtctgggacagatttcactctcaccatcagcagcctgcagctgaagatgtggctagtttattctgtctgctagtatttgggacctcgtcggtactttggcgtcgagggaccaagggtggagatcaaaggcgaaactggtggcttgaccaccatctagtctttcntctccccg

SEQ ID NO: 169112 - DNA, 547 bp, Homo sapiens
  misc_feature: GYAE6OF01BKIX2.37.11.A11.1.454.CMB.1.raw
  modified_base (287)..(287): a, c, t, g, unknown or other
  misc_feature (287)..(287): n is a, c, g, or t
  modified_base (377)..(377): a, c, t, g, unknown or other
  misc_feature (377)..(377): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcacgcctacctaaactgctcatttacgngggcatccgtacccggggaggtcccggggtccctgaccgattcgagtggcgaggcggtcgtggacagtactttcactctcaccatcaacncgcctgcaggctggaggagtggtaggctaatttactactgtcagactagtattaataactctcctcgtacgttcgaccgaaggacgaaggtcgaaatacgaaacgacgtgtaggctcggacctacattcgtcgttaccttactacttcccttacccgcctacttcgtacg

SEQ ID NO: 169113 - DNA, 504 bp, Homo sapiens
  misc_feature: GYAE6OF01BENFF.37.11.A11.1.454.CMB.1.raw
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (498)..(498): a, c, t, g, unknown or other
  misc_feature (498)..(498): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatcctacccgggagtccggggtccctgaccgattcagtggcagcgggtctggacagatttcactctcaccatcaacngccngcaggctgaggatggtggctatttatacgtgtcagcagttataatatactcctcgacgttcgacaagggtaccaaggtacgaatacaaacgaactgtgctgccacatctgtcttcacttcctacccgctntctacg

SEQ ID NO: 169114 - DNA, 567 bp, Homo sapiens
  misc_feature: GYAE6OF01CMUGX.37.11.A11.1.454.CMB.1.raw
  modified_base (208)..(208): a, c, t, g, unknown or other
  misc_feature (208)..(208): n is a, c, g, or t
  modified_base (408)..(408): a, c, t, g, unknown or other
  misc_feature (408)..(408): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcagaaaccagggcagcctacctaaactgctcatttactgggcatcgtacccggagtccggggtcctgaccgattcagtggcagcgggtctgggacaggtattcaactctcaccataccaaacacgcctgcgaggccttaggaggatggtaggcgtaatttntactgtcagcagtattataatctccgtcgacgttcggacctaaagggaccaaggtacggaaatacgaaaacgtaactggtacggactacgacctaaccctattccgtacggtttaccttacgtacgttacccctttaccccggcctattcgttaaaccg

SEQ ID NO: 169115 - DNA, 508 bp, Homo sapiens
  misc_feature: GYAE6OF01C62Z3.37.11.A11.1.454.CMB.1.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
  modified_base (502)..(502): a, c, t, g, unknown or other
  misc_feature (502)..(502): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcaagaaaccaggcagcctcctaaacngctcatttactgggcagtctaccgggagtccggggtcctgaccattcagtggcagcggtctggacagattcactctacacatcaacagctgcaggctagaggatgtggacgtatttatactgtcagctagtacttagtaactactcctcgacgttcggaccgaagggaccaaggtacgaaatcgaaacgaactgagctgacaccatctagtctactactcctacccgcntctaag

SEQ ID NO: 169116 - DNA, 513 bp, Homo sapiens
  misc_feature: GYAE6OF01C6PQE.37.11.A11.1.454.CMB.1.raw
  modified_base (386)..(386): a, c, t, g, unknown or other
  misc_feature (386)..(386): n is a, c, g, or t
  modified_base (507)..(507): a, c, t, g, unknown or other
  misc_feature (507)..(507): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctaccaacaataagaactacttagcttggtatcagcaagaaaccagggcagcctacctaaactgctcatttactgggcatccgtaccgggagtcccgggtccctgaccgattcagtggcagcgggtctgggacagtattcactctcaccatcaacagcctgcaggctgaggatgnggcgtatttatactgtcagctagtattataactactcctacgtacgttcgaccgaagggaccaaggtgaaactcaaaacgtactggtgctgaccactatctgtccttcacttcctcccgcntctacg

SEQ ID NO: 169117 - DNA, 592 bp, Homo sapiens
  misc_feature: GYAE6OF01EAA24.37.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccaggcagcctactaaactgctcatttacnggcatcgtacccgggagtccgggtcctgaccgattcagtgcagcggtctggacagtattcactctcaccatacaacagcctgcaggctggagatgtggacgtatttattactgtacagtacaagttaattaataacttaccttccgtaccgtaacggttccggaccgaaacggggtaaccaaagggtacgaaaacttaccgaaaaacgtaacgttagggtacggacgttacggacccaacccgtacttccgttacggttaccctttaccgtactttacccgttacccccgaccttagttcccgtaaacg

SEQ ID NO: 169118 - DNA, 614 bp, Homo sapiens
  misc_feature: GYAE6OF01EPXHC.37.11.A11.1.454.CMB.1.raw
  modified_base (384)..(384): a, c, t, g, unknown or other
  misc_feature (384)..(384): n is a, c, g, or t
tcagtagtgtagatcacgaccggtgctcgatttagctacgactgcaggggcgagcaagatggtgttgccagacccaggtcttcatttctcttgttgctctggatctctggtgcctacggggacaccgtgatgacccagtctccagactccctggtctgtgtctctgggcgagagggcctccatcaactgcaagtccagccagactggttttatacagctccaacaagtaacgaactacttagctttggtatcagcagaaaccagggcagcctacctaaaactgctcatttactgggcatccgtacccggggagtcccggggtccctggaccgattcgagtggcagcgggtctgggacagtatttcacttctacaccatacaacngcctgcaggctgagatgtggctatttatactgtcagcaagttattaataacttaccttccgtaccgtaacgtttaccggaccgtaaaggggtacccgtaaagggttacggaaacgtaccgaaaaccggtaacgtcgggttacggtaccttacggacctaacccgtagttccgttacgttacctttacccgtactttcccgttaccccggtcccgttagttccgttaacgg

SEQ ID NO: 169119 - DNA, 543 bp, Homo sapiens
  misc_feature: GYAE6OF01EYXW1.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctacctaaactgctcatttactgggcatcgtacccgggagtcccggggtccctggaccgattcgagtggcaggcgggtctgggacagtatttcactctcaccatacaacagcctgcaggctgaggatggtggcgtatttatactgtacagctagttattaataacttacctcctaccggtacgttccggaccgaagggtaccgaaagggtagaaactacgaaacgtacgtgtacggactacgcacctatctcgtcttctactccttacccgctatcgtaac

SEQ ID NO: 169120 - DNA, 493 bp, Homo sapiens
  misc_feature: GYAE6OF01D2RUE.37.11.A11.1.454.CMB.1.raw
  modified_base (283)..(283): a, c, t, g, unknown or other
  misc_feature (283)..(283): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatcgtacccgggagtccggggtccctgaccgattcagtggcagcggtctgggacagatttcactctcacatcaacagcctgcaggctgaggatgtggcgtatttatactgtcagcagtattataatctcctcgacgttcggaccaagggaccaaggtgaaatcgaaacgactgtgctgcacatctgtctcnttctcccgcntctag

SEQ ID NO: 169121 - DNA, 513 bp, Homo sapiens
  misc_feature: GYAE6OF01EJYLA.37.11.A11.1.454.CMB.1.raw
  modified_base (287)..(287): a, c, t, g, unknown or other
  misc_feature (287)..(287): n is a, c, g, or t
  modified_base (375)..(375): a, c, t, g, unknown or other
  misc_feature (375)..(375): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaaacaataagaactacttagcttggtatcagcaagaaaccagggcagcctacctaaactgctctatttacngggcatccgtacccggggaggtcccggggtccctgaccgattcagtggcaggcgggtctgggacagtatttcactctcaccatcaacngcctgcgaggctggaggatggtggtctatttattactgtcagctagtattataatcctcctcgacgttcgacgaagggtaccaaggtacgaatacaaacgatgtgctgccacntctntctctatcctccncntctacg

SEQ ID NO: 169122 - DNA, 808 bp, Homo sapiens
  misc_feature: GYAE6OF01EIFW8.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctccagacctccctggctgtgtctcgtgggcgagagggcctccatcaactgcaagtccagccagacttgttttanacagctaccaaacaataagaactacttagcttggtatcagacaagaaaccgagggccacgccctacctaaaactgaccttactaagtttacgtgggacctacgttaccggtaccccggggtacggttccccggggtaccctacggtaccgtattaccgaggtcggcgtacgggtccgggtcgtacgggactacggttactttccgactcctacctaacctaactaccgaaacacgtcctacggaccgtacgggcctaagggtaaggtagttcggttagggtaccgtttaaattttacgtttaaccgtacggttacgtaacgtaacgttaaacgtttaaacttttaacgttaaacctttacccgttaccccggttacccgggttaaaccggtttaccccggggaaacccgtaaacgggggtaaaccccgtaaaggggttaacggaaaaccgttaacccggaaaaaccggtaaccggttacgggtacgggttaaccgttccggaacccgttaacccgtaacgtttccgttaccggtttaccctttaccgtaacccgtttccccccgttaccccgtacccttaaacgtttccgtaaaaccg

SEQ ID NO: 169123 - DNA, 519 bp, Homo sapiens
  misc_feature: GYAE6OF01DNLNZ.37.11.A11.1.454.CMB.1.raw
  modified_base (285)..(285): a, c, t, g, unknown or other
  misc_feature (285)..(285): n is a, c, g, or t
  modified_base (371)..(371): a, c, t, g, unknown or other
  misc_feature (371)..(371): n is a, c, g, or t
  modified_base (512)..(512): a, c, t, g, unknown or other
  misc_feature (512)..(512): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctcctaaactgctcatttacngggcatcgtacccggggagtcccggggtccctgaccgattcgagtggcagcgggtctgggacagatttcactctcaccatcaaacncgcctgcaggctgaggatggtgcttatttattactgtcagtcagtattataatactctcgacgttcgacaagggacaaggtagaatcaaagtactgtcgctcgacacattctacgttcttactacttcccttcccgacctntctaacg

SEQ ID NO: 169124 - DNA, 582 bp, Homo sapiens
  misc_feature: GYAE6OF01DGYHF.37.11.A11.1.454.CMB.1.raw
  modified_base (284)..(284): a, c, t, g, unknown or other
  misc_feature (284)..(284): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctacaacaataagaactacttagcttggtatcagcagaaaccagggcagcctcctaaactgctctatttacngggcagtccgtacccgggagtcccggggtcctgaccgattcagtcggcagcgggtctgggacagtattcactctcacatacaacacgcctgcaggctagacggtatggtggacttagtttatacgtgtacagctaagttattaactaactacttccgtaccggtaacgttaccggaccgtaaggggtaacctaagggtacgtaaactaccgaaaacgtacgtaggtcggacttcgaccgtaccacgttcgtacgttacttaccgtacttcccttaccccggacctacgtccttaacgg

SEQ ID NO: 169125 - DNA, 554 bp, Homo sapiens
  misc_feature: GYAE6OF01ETLQM.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttactgggcatcgtacccgggagtccgggtcctgaccgattcagtgcaggcggtctgggacagatttcactctcacatcaacagcctgacgcgtgaggagtgtggtcgtattaatttactagtcgtacgacgtacgtagttataatactacctccgtacggtacgtaccgaacggaacgtaacgtaaggtaacgtaactaacgaaacgtacgtggtacgtacgtacgaccactactcgttcgttactacgtaccttccctacccgctctcgtaac

SEQ ID NO: 169126 - DNA, 548 bp, Homo sapiens
  misc_feature: GYAE6OF01DXQNT.37.11.A11.1.454.CMB.1.raw
  modified_base (285)..(285): a, c, t, g, unknown or other
  misc_feature (285)..(285): n is a, c, g, or t
  modified_base (377)..(377): a, c, t, g, unknown or other
  misc_feature (377)..(377): n is a, c, g, or t
  modified_base (540)..(540): a, c, t, g, unknown or other
  misc_feature (540)..(540): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctctatttacnggcatctaccgggagtcccgggtcctgaccgattcagtggcaggcggtctggacagtattcactctcaccatcacagcctgcagctgaggtntgtggacgtatttactactgtacagtctaagtattaataacttactcccgtacgtaaccgttccggaccgtaaaggggtaccaaagggtacgaaactaccgaaaacgtacgtggtacggctacgctaccattctacgttccttaccattacccttcccgaccnttcgtacg

SEQ ID NO: 169127 - DNA, 572 bp, Homo sapiens
  misc_feature: GYAE6OF01CM7AE.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctacaacaataagaactacttagcttggtatcagcagaaaccagggcagcctacctaaactgactcatttactgggacatccgtacccggggagtcccggggtcctggaccgattcgagtggcaggcgggtctggacaggtattcactctcaccatcaacagctgcagctgagatggtgtcgtaatttatactgtacagctaagttattataactacctccgtaccgtacgttaccggaccgtaaacgggacctaaagggtacgaaaactcgaaaacgtacgttaggtcggactacgacctaaccgtattccgtacgttacctttaccgtacttcccttaccccgcctagttccgtaacg

SEQ ID NO: 169128 - DNA, 645 bp, Homo sapiens
  misc_feature: GYAE6OF01BNGVI.37.11.A11.1.454.CMB.1.raw
  modified_base (338)..(338): a, c, t, g, unknown or other
  misc_feature (338)..(338): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttatacagctaccaaacaataaagaacttacttagctttaggtatcagacaagaaaccagggcagcctacctaaactcgctctatttacgtcggacagtccgtacccgggacgtcccgggtacctgaccgtnttcgaggtgcaggcggtcgtggactagtactttcactctacactactaccaacacgcctagacgaggtctaggaggtactggtaggtacgtattttaacgtacgttgtacagtacttaagttacttaacgttaacttaccgtacccgtacggtacccgtttacgggacccgtaaaacggggtaccgtaaagggtacgaaacttaccgaaaacgttacgtggtacggacgtacgaacccgtactacgttccgtacgtttaccttaccgtaacctttccctttaccccggacttaaccgtcgttaaacg

SEQ ID NO: 169129 - DNA, 519 bp, Homo sapiens
  misc_feature: GYAE6OF01DC6Z7.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaccagggcagcctctaaactgctcatttactgggcatcgtacccgggagtccgggtcctgaccgattcgagtgcagcggtctggacagtattcactctcacatcaacagcctgcagctgagatgtgcgtatttatactgtacagctagtattataactactcctcgacgttcggaccaagggtaccaagggtcgaaactacgaaacgtaactggtcgctagctacattcgtagttcttactacttcccttacccgctatccgtaacg

SEQ ID NO: 169130 - DNA, 508 bp, Homo sapiens
  misc_feature: GYAE6OF01BMJWZ.37.11.A11.1.454.CMB.1.raw
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
  modified_base (503)..(503): a, c, t, g, unknown or other
  misc_feature (503)..(503): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatcgtacccgggagtccgggtccctgaccgattcagtggcagcgggtctggacagattcactctcaccatcaacngcctgcaggctgaggatgtggctatttatactgtcagctagttattataatctacctccgtacgttcggaccaacgggtacctaaagggtcgaaatacgaaacgtactgtggactgcacatctctcttcatcctcccgctntctac

SEQ ID NO: 169131 - DNA, 566 bp, Homo sapiens
  misc_feature: GYAE6OF01B6L51.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccagggcagcctacctaaactgctctatttactgggacacgtccgtacccggggagtcccggggtccctggacccgtattccgaggttcggcaggcgggtctgggacagtatttcactctcaccatacaacacgcctgcaggctggagatgtggactagtttatacgtgttcagtactagtattataactctcctacgtacgttaccgacgaacgggtaccaagggttacgaaactcgaaaacggactaggtacggactaggcctaacctagtctagttccttactacttcccttacccgctagttcctaacg

SEQ ID NO: 169132 - DNA, 509 bp, Homo sapiens
  misc_feature: GYAE6OF01C186L.37.11.A11.1.454.CMB.1.raw
  modified_base (383)..(383): a, c, t, g, unknown or other
  misc_feature (383)..(383): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatcctacccgggagtccggggtccctgaccgattcagtggcagcgggtctggacagatttcactctcaccatcaacagcctgcaggctgaggatgnggctatttattactgtcagcagtattataatactcctcgacgttcgaccgaagggccaaggtggaaatcgaaaacgactggtgtactgcaccattctgttcttacattccttcccgctgtctaacg

SEQ ID NO: 169133 - DNA, 495 bp, Homo sapiens
  misc_feature: GYAE6OF01BKJCX.37.11.A11.1.454.CMB.1.raw
  modified_base (362)..(362): a, c, t, g, unknown or other
  misc_feature (362)..(362): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctctaaactgctcatttactgggcatcgtacccgggagtccggggtccctgaccgattcagtggcagcgggtctggacagattcactctcaccatcaacngcctgcaggctgaggatgtggcgtatttatactgtcagcagtattataatactcctcgacgttcgaccgaagggaccaagggtagaatcaaacgactgtggctgcacatctgtctcntcctccnctntctacg

SEQ ID NO: 169134 - DNA, 513 bp, Homo sapiens
  misc_feature: GYAE6OF01BT2VO.37.11.A11.1.454.CMB.1.raw
tcagtagtgtagatcacgaccggtgctcgatttagctacgactgcaggggcaacaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggctatttatactgtcagtctagttattataactaccctcctcgtacgtcgacgaacggacgtaggagtaacacgaacgagtgtagacctacactactctgtctactactccgtccactatctgtactac

SEQ ID NO: 169135 - DNA, 745 bp, Homo sapiens
  misc_feature: GYAE6OF01DF5DX.37.11.A11.1.454.CMB.1.raw
  modified_base (218)..(218): a, c, t, g, unknown or other
  misc_feature (218)..(218): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatgacccagtctccagactccctggctgtgtctcgtgggcgagacggcctaccatacaactgacaacgtccagacctagtacttgttttaanaccacgctaccaaataaataacgtaacttacgttagtcgttaggtactacgacgacgaaacgaaccggacggaccacgtaccctaaccgtaaactcgtaccttacgtaacggtttacgcggtacctaccggttaccggttaccccgggggtacgttccccggggtaccctaggtacctagttcggaggtcggaccgtaggtccgggtctaggacttacgtacttccactacctaccaacccgaacttaccgaacgtacggccgtacggacgtagggtacgtaggacgggtagttggttacggttacgtttaagtttacgttacgttagtaacccgtaagttaccgttaagttttactttacgtttacgtttacccttaccgttacgttaacggttagggttttaacccgggaccgggtaaacggggtaccgaagtcggtacggacgtaacgtaccgtacgaacggtacgtcgtaccgactccgacctacgtacgttccttcgttaccctccttacctccgttacccg

SEQ ID NO: 169136 - DNA, 606 bp, Homo sapiens
  misc_feature: GYAE6OF01A2YV6.37.11.A11.1.454.CMB.1.raw
  modified_base (284)..(284): a, c, t, g, unknown or other
  misc_feature (284)..(284): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacgngggcatcgtacccgggagtcccggggtccctgaccgattcagtggcaggcgggtctgggacagatttcactctcaccatacaacagcctgcaggctgaggatggtggctaatttattaacgtgtacagctaagttattaataacttacctcccgtaccggtaccggttaccggaccgtaaacggggtaaccaaagggttacggaaaactaccgaaaaccggtagtacggtacgggtacctacggacctaacccgattccgttacggttaccctttaccgtaacctttaccccgttacccccgaccctaaagttccgtaaacg

SEQ ID NO: 169137 - DNA, 506 bp, Homo sapiens
  misc_feature: GYAE6OF01D59F3.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctaccgggaatccggggtccctgacgattcagtggcggcgggtctgggacagatttcactctcaccatcagcagcctgcggctgaagatgtggtcgtttattactgtcagcagtattatgttactcctcactagttttcggccgagggaccaagcgtggagatcgcacgaacgtgtgctgcacatctgtcttcacttccttcccgccactctgtaac

SEQ ID NO: 169138 - DNA, 562 bp, Homo sapiens
  misc_feature: GYAE6OF01E4QMM.37.11.A11.1.454.CMB.1.raw
  modified_base (211)..(211): a, c, t, g, unknown or other
  misc_feature (211)..(211): n is a, c, g, or t
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
tcagtagtgtagatcacgaccggtgctcgatttagctacgactgcaggggcagcaagatggtgttgcagacccaggtcttcatttctcgtgttgctctggatctctggtgccgtacggggacaccgtgatgaccccagtctccagactccctggctgtgtctctgggcgagagggcctccatcaactgcaagtccagccagactgttttanacagctccaacaataagaactacttagcttggtatcagcagaaaccagggcaggcctcctaaactgcctcatttacngggcatcgtaccgggagtccggggtcctgaccgnttcgagtggcagcggtctaggacagtattcactctacaccataccaacngccctgcagggctgaggntggnggtcgtatttatactgtcagtcagttatataatcctctacgtacgttcggaccgaagggacctagggtacgaatacgaaacgactggacggtctacggcctaacgattccgttacgttacctttaccgtactttcccccgttaccccggcctaagttcccgttaaccgg

SEQ ID NO: 169139 - DNA, 928 bp, Homo sapiens
  misc_feature: GYAE6OF01BJ2Y9.37.11.A11.1.454.CMB.1.raw
tcagtagtgtagatcacgaccggtgctcgatttagctacgactgcagggcagctaagggatggtgttcgcagacccagggtacttcacgtttcttctgttgctctggatctctggtacgcctacggggacaccgtgactgacccgagttcgtccagactccctgggttcctgtgtctcttagggcgtagacggcctccatcgaactcgacaacgttccgaggcccgtaggtacggttggtttttaacaccgacgacctacccaaacgaaacttaaccgaactacttagtcttcggtatcagcaacgaaccagggctacgaccttacctaaactggacctactagtttacctggggacctacgttccggtaccccgggggtacggtccccggggtacccgtcggaacccggtagtttccgaaggggtcggacggtagggtccggggtcgtacgggaactagtacgtttaccacgttacctacgaaccgtattaccgaaacgtacgtacccgttacgggaccgtaacgggtccgttacggggaagggtaccgtttacgggttaccggggtacccgtttaacgtttttaacgttaaccggtacgggttacccgtaaacggttacccgtaaaggttttaaaccttttaaacgttaaaccgtttaccccgttaaccccgttaacccgggtttaaccgtttacccgggggaaacccgtaaaacgggggttaacccttaaacgggggttaacccgtaaaaacggttaaccccgtaaaaacgggtaccggtttaaacggggtaccgggacccggttttacgggaaccctttaaacccgttaaggttttcccgtttacgggttacccgtttacccgtaaacccggtttccccggttaaccccccccggtaccttaacgggttaccccggttaaccgg

SEQ ID NO: 169140 - DNA, 511 bp, Homo sapiens
  misc_feature: GYAE6OF01DOJLS.37.11.A11.1.454.CMB.1.raw
  modified_base (369)..(369): a, c, t, g, unknown or other
  misc_feature (369)..(369): n is a, c, g, or t
  modified_base (501)..(501): a, c, t, g, unknown or other
  misc_feature (501)..(501): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaccagggcagcctacctaaactgctcatttactgggcagtccgtaccgggagtcccggggtccctggaccgattcgaggtcgcaggcggtctgggacagtattcactctcaccatcaacngcctgacaggctgaggatggtggctatttattactgtcagtctagtattataatctcctcgacgttcgacaagggactaaggtgaaactcgaaacgactgtagctgcacattctgtcttacacttcctcccnctatcgtacg

SEQ ID NO: 169141 - DNA, 552 bp, Homo sapiens
  misc_feature: GYAE6OF01DPXF1.37.11.A11.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (391)..(391): a, c, t, g, unknown or other
  misc_feature (391)..(391): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctacaacaataagaactacttagcttggtatcagcaagaaaccaggcagcctacctaaactgctctatttacnggcatccgtacccgggagtcccggggtcctgaccgtattcgagtggcgacggcggtcgtgggactagtattcactctcaccatacaacagcctgcaggctgaggtntggtggtcgtatttacgtactgtcagtctaagttattaatactactccgtacgtaccgttacgaccgtaacgggtaccaaaggtcgaaactcaaaacgtagtcgtgactacgactacctaatcttacgtcttacgaccttccttacccgcctatcctaacg

SEQ ID NO: 169142 - DNA, 595 bp, Homo sapiens
  misc_feature: GYAE6OF01EC6HY.37.11.A11.1.454.CMB.1.raw
  modified_base (293)..(293): a, c, t, g, unknown or other
  misc_feature (293)..(293): n is a, c, g, or t
  modified_base (398)..(398): a, c, t, g, unknown or other
  misc_feature (398)..(398): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttatacagctaccaaacaataaagaactacctagcttggtatcagacaagaaaccgagggcagcctacctaaactgctctatttacngggcacgtccgtaccccggggaggttcccggggtccctggacccgtattcgaggtcggcgaggccgggtcgtgggactagtactttcactctacaccatacaacncgcctgcgaggctggaggtatggtggtactatttactctgtacgagtctaagttattaatacttacctcctacggtacgttacggaccgaagggtaccgtaaggtacgaaataccgtaaacgtacgtggtacgctacgacctaccattccgtacgttcccttactacctttcccgttaccccgactcgttctaaccg

SEQ ID NO: 169143 - DNA, 502 bp, Homo sapiens
  misc_feature: GYAE6OF01A64WE.37.11.A11.1.454.CMB.1.raw
  modified_base (364)..(364): a, c, t, g, unknown or other
  misc_feature (364)..(364): n is a, c, g, or t
  modified_base (479)..(479): a, c, t, g, unknown or other
  misc_feature (479)..(479): n is a, c, g, or t
tcagtagtgtagatcacgaccggtgctcgatttagctacgactgcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttcttagcttggtaccagcagaaaccacgacagcctctaagctgctcgtttactgggcctctacccgggaatccggggtccctgaacgattcagtggcggcgggtctggggacagatttcactctcacntcagcagcctgcgggctgaagatgtggtcggtttatacgtgtcagcagtattatgttactctctactagtttggccgtagggacctaagctggagatcgcacgactgtggctgcncatctgtctcatccttccgctac

SEQ ID NO: 169144 - DNA, 556 bp, Homo sapiens
  misc_feature: GYAE6OF01COHY5.37.11.A11.1.454.CMB.1.raw
  modified_base (209)..(209): a, c, t, g, unknown or other
  misc_feature (209)..(209): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgttttanacagctacaacaaataagaactacttagcttggtatcagacaagaaaccagggcacgcctacctaaactgcttcatttaacgtgggacatccgtaccccggggacgtcccggggtccctaggaccgattcgagtggcgaggcgggtcgtgggacagtattcactctcacatacaacncgcctgcaggctaggaggatggnggtacgtaatttatactgtacagtctaagtattaataactacgtcccgtacgtacgtacggaccgaaagggaccaaagggtagaaactagaaaccgtatggtgactagcctaccattcgtgtctctacttcctacccgctatcgtag

SEQ ID NO: 169145 - DNA, 512 bp, Homo sapiens
  misc_feature: GYAE6OF01A82PA.37.11.A11.1.454.CMB.1.raw
  modified_base (508)..(508): a, c, t, g, unknown or other
  misc_feature (508)..(508): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgatccagtctccagactccctggctgtgtctctgggcgagagggcctccatcaactgcaagtccagccagactgttttatacagctaccaacaataagaactacttagcttggtatcagcagaaaccagggcagcctcctaaactgctcatttactgggcatccgtacccgggagtcccggggtcctgaccgattcagtggcagcgggtctgggacagacttcactctcaccatcaacacgcctgcaggctgagatgtgcgtatttatctgtcagctagtattatatactctcgacgttcggacctaaggaccaaggtacgaatacgaaacgtactgtgcgtcgacactatcgtcgttccttacacttcccttcccgctntccg

SEQ ID NO: 169146 - DNA, 816 bp, Homo sapiens
  misc_feature: GYAE6OF01D1P5J.37.11.A11.1.454.CMB.1.raw
  modified_base (792)..(792): a, c, t, g, unknown or other
  misc_feature (792)..(792): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggccgtgtctctggcggaggagggccgtccactacaactagcaacgtaccacgccacgacttgttttaattacacgctacccaaacaaataaagtaaactacttaagtcttcggtatacacgacaacgaaaaccaagggacgacgaccctacctaaactagctactactttaacgttcggcgactacgtacccggggacgggttcccggggtcccgtcgacggtacttacgtacgtaggccgacgggtcggggtccgtaggggaccgaagtaatttcctaccgtcctaccctaacctaactaacgaaacccaacggtcccttaggaccgtaacggggtaccgtttagggaaagggggtactttacgggggttcgggtaaaccgtttaatttttttaagttaaacccgttggttaccggtacgacgtttaagtttaaacgttttaacttaaaacgttaccccttacccggtttacccccgggtacgttttaaccggggaacccgaaaaaccggggggttaacgaaacgggttaaacggggtaaacttaaccgaaaaccggtaaacgtttcgggtacgtccgtacggtacccaaacctaagttctttcggtacctttacccgaacttttcccttaaccccccggntttaaacgccttttagaaaacccg

SEQ ID NO: 169147 - DNA, 493 bp, Homo sapiens
  misc_feature: GYAE6OF01AJKXG.37.11.A11.1.454.CMB.1.raw
  modified_base (488)..(488): a, c, t, g, unknown or other
  misc_feature (488)..(488): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgtatttatactgtcagcagtattataatctcctcgacgttcgccaagggaccaaggtgaaatcaaacgactgtcggctgcacatctgtctcatctcccgctntctag

SEQ ID NO: 169148 - DNA, 602 bp, Homo sapiens
  misc_feature: GYAE6OF01CYRQ6.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctacaacaataagaactactagcttggatcagcagaaaccagggcagcctactaaactgctcatttactggcatctaccgggagtccgggtcctgaccgattcagtggcagcgggtctggacagatttcactctcaccatacaacagcctgacaggctaggaggtatggtggacgtaattttaattacgtgtaccagtctaagtatttaataactactccctaccggtacgttccgggacccgaaaggggtaaccctaaagggtagggtaaaactaccgaaaaaccggtaacgttggtacgggtaccttacggacccaacccgtaattccttacggtttccctttacctaacgttcccttaccccccggacctaacgttccgttaaaccgg

SEQ ID NO: 169149 - DNA, 579 bp, Homo sapiens
  misc_feature: GYAE6OF01EWEKD.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaaacaataaagaactacttagcttggtatcagcaagaaaccagggcagcctacctaaaactgctcatttactgggcatcgtacccgggagtcccggggtccctgaccgattcagtggcagcgggtctgggacagattcactctcaccatcaacagcctgcaggctgagatgtggcgtaatttatactgtcagctaagtattaataattacctcctaccgtacggttaccggacccgtaaaggggacctaaagggtaggtaaaactacgaaaaacgaaactggtaggaccgttacggaccaacccagttccttgttccctttactacgttcccctttaccccggcccctaattcccttaaagg

SEQ ID NO: 169150 - DNA, 529 bp, Homo sapiens
  misc_feature: GYAE6OF01AM8LP.37.11.A11.1.454.CMB.1.raw
  modified_base (384)..(384): a, c, t, g, unknown or other
  misc_feature (384)..(384): n is a, c, g, or t
  modified_base (476)..(476): a, c, t, g, unknown or other
  misc_feature (476)..(476): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttactgggcatcctacccgggagtccggggtccctgaccgattcaggtggcaggcgggtctgggacagtattcactctcaccatcaacagcctgcaggctgaggntgtggctatttatactgtcagctagtattataactactcctacgtacgttcggaccgaagggaccaaggtaggaaactacgaaacgtactgnggtctacgcacctattctgttccttctacttcccttacccgcctagtcctacg

SEQ ID NO: 169151 - DNA, 553 bp, Homo sapiens
  misc_feature: GYAE6OF01CE5PU.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcagaaaccagggcagcctacctaaactgctctatttactgggcatcctacccgggagtcccggggtccctgaccgtattcgagtggcagcgggtctggacagattcactctcaccatcaacacgcctgcaggctggagatgtggcgtatttattactgtcagtctaagtattaataactacctccgtacgtacgttcggaccaagggaccaaggtaggaaactcgaaaacgtacgtaggtacgctacgccaactacttcgttacgttccttactaccttcccttaccccgactacgttccgtaacg

SEQ ID NO: 169152 - DNA, 511 bp, Homo sapiens
  misc_feature: GYAE6OF01AEWJG.37.11.A11.1.454.CMB.1.raw
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtcccggggtccctgaccgattcagtggcagcgggtctgggacagatttcactctcaccatcaacagcctgcaggctgaggatggtggcgtatttatactgtcagcagtattataatactcctccgtacgttccggccgaagggaccaaggtagaaactacgaaacgtactgtggctgccacatctgtcttcacttcctcccnctntctacg

SEQ ID NO: 169153 - DNA, 537 bp, Homo sapiens
  misc_feature: GYAE6OF01D6AWU.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctcattttactgggcatccgtacccggggagtccggggtccctgaccgattcagtggcagcgggtctgggacagatttcactctcaccatcaacagcctgcaggctggaggatggtggacgtatttattactgtcagctagtattaatactactccctcggaccgtttcggaccgaaggggtaccaaggggtagaaactacgaaacgtaacgtggtgctgccactactctgtccttctacttccttcccgcctatcgtaacg

SEQ ID NO: 169154 - DNA, 577 bp, Homo sapiens
  misc_feature: GYAE6OF01B7TQ0.37.11.A11.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (543)..(543): a, c, t, g, unknown or other
  misc_feature (543)..(543): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgtttanacagctccaacaataagaactactagcttggatcagcaagaaaccgagggcagccctctaaactgctctatttacgngggcacgtccgtaccgggacgtcccggggtcctgaccgtattcgagtcggcaggcgggtcgtggacagtattcactctcaccatcaacncgcctcgcgaggtctaggacggngtggtggtcgtaatttacgtacttggtccagtctaagttaacttaataacgttctaccgtaccgtaccgttaccggaccgtaacgggaccgtaaagggtacgaaactaccgaaaacgtactggtacggctacgaccgactatcgtnttcctactacttcccttacccgctacgtgttacg

SEQ ID NO: 169155 - DNA, 599 bp, Homo sapiens
  misc_feature: GYAE6OF01BPAUF.37.11.A11.1.454.CMB.1.raw
  modified_base (169)..(169): a, c, t, g, unknown or other
  misc_feature (169)..(169): n is a, c, g, or t
  modified_base (293)..(293): a, c, t, g, unknown or other
  misc_feature (293)..(293): n is a, c, g, or t
  modified_base (404)..(404): a, c, t, g, unknown or other
  misc_feature (404)..(404): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagngggcctccatcaactgcaagtccagccagactgttttatacagctacaaacaataagaactacttagcttggtatcagacaagaaaccagggacacgacctacctaaactgactacatttacgnggcatccgtacccgggagtccgggtcctgaccgtattcgagtgcgaggcgggtcgtaggacagtacttcacgtctacacctagtacaacagtcctgacgaggctaggaggntggtgacgtaatttatacgtgtcagtctaagtattataacgtctaccgtcgtaacgttcggaaccgtaagggtaccctaagggtacgaaacctacgaaaacggtacgtggtacggaccttaacggcctaaccttagttccgttacgtacctttaccgaactttccccgttaacccggacttagttcccgtaaacg

SEQ ID NO: 169156 - DNA, 781 bp, Homo sapiens
  misc_feature: GYAE6OF01A03RS.37.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccagggcagcctacctaaactgctcatttacgnggcatccgtacccgggagtcccgggtcctgaccgtattcgagtcggcaggcgggtctgggacagtactttcactctacaacctagtaccaaacgacgtcccttcggacaagggccttagggaacggtacgttcgggtacgggtaccgttaagtttttaacgttaaccgttaggttaccgtaaggtaccgttaaaggtttaactttaaacgtttaaacctttacccgttaccccgttacccgggtaacccgggtttaacccgggaaccccggtaaacgggggtaaaccccgtaaaggggtttaaccgggtaaaaacttaacccggaaaaaaccggttaaccggttacggggttaccgggtacccggttaacggtaacccgtaaaccccgttacgtttacccgttttacgggtttaaccccttttaccgttaaaccccgttttaccccccggtttaccccccggaccctttaaaccggtttacccgtttaaaaccgg

SEQ ID NO: 169157 - DNA, 578 bp, Homo sapiens
  misc_feature: GYAE6OF01CHG2P.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctacaacaataagaactacttagcttggtatcagacaagaaaccgagggcagcctacctaaactgctacatttactgggcatccgtacccgggacgtccgggtcctgaccgtatcagtggcaggcggtcgtggacagtatttcactctacacatacaacacgctgcaggctagagatcggtagcgtatttatactgtacagctaagtattaataactctccctccggtacgttccggaccgaaacgggtaccaaagggtagaaactacgaaaacgtacctaggtacggcttacggcctaaccctattccgttacgttacctttacctaccgtttccccttaccccggaccctaattccgttaaacg

SEQ ID NO: 169158 - DNA, 553 bp, Homo sapiens
  misc_feature: GYAE6OF01A62I5.37.11.A11.1.454.CMB.1.raw
  modified_base (369)..(369): a, c, t, g, unknown or other
  misc_feature (369)..(369): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctcatttactgggcatccgtacccgggagtcccggggtcctgaccgatcgagtggcagcgggtctgggacagactttcactctcacatcaaacngcctgcaggctggaggatggtaggtacgtatttaattacgtgtcaggctagtacttaataactacctccgtccgtacgttcgggaccaacgggaccgtaagggtacgaaacttacgaaacgtaacgtggtacggctagccacattcgtcgttcttacactttccctcccgcctagttcctaacg

SEQ ID NO: 169159 - DNA, 544 bp, Homo sapiens
  misc_feature: GYAE6OF01C39LR.37.11.A11.1.454.CMB.1.raw
  modified_base (385)..(385): a, c, t, g, unknown or other
  misc_feature (385)..(385): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttatacagctaccaacaataagaactacttagcttggtatcagcaagaaaccagggcagcctacctaaactgctcatttactgggcatctaccgggagtcccggggtcctgaccgattcgagtggcagcgggtctggacagatttcactctcaccatcaacagcctgcaggctgaggatgnggctatttatactgtcagcagtattataatactcctaccgacgttccggaccgaagggaccaaggtacggaaactcaaaacgtaacgtggtcggactcggacctacctagttccttacgttcctttacactttcccttaccccggacctattcgtaacg

SEQ ID NO: 169160 - DNA, 626 bp, Homo sapiens
  misc_feature: GYAE6OF01DLIWZ.37.11.A11.1.454.CMB.1.raw
  modified_base (210)..(210): a, c, t, g, unknown or other
  misc_feature (210)..(210): n is a, c, g, or t
  modified_base (287)..(287): a, c, t, g, unknown or other
  misc_feature (287)..(287): n is a, c, g, or t
  modified_base (368)..(368): a, c, t, g, unknown or other
  misc_feature (368)..(368): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagacgggcctccatcaactgcaagtccagccagacttgttttanacagctaccaacaataagaacttacttagcttggtatcagcagaaaccagggcagcctactaaactgctcatttacnggcatcgtaccgggagtccgggtcctgaccgattcagtggcgaggcggtcgtggacagtattcgactctcaccatacaacncgcctgacaggcctaggaggtatggtcgtacgttaattttacgtacgtgtaccaagtactaagtttaactttaacttaacttaccgttcccttaccgggtaccggtttaccgggaccgtaaacggggtaccctaaaagggtacggaaaactaccgaaaaacggtacgttcggtacggtacctacggacctaccaagtttccctaggttaccctttacctacgtttaccccttaccccgtctttaccgtggttaaaccc

SEQ ID NO: 169161 - DNA, 492 bp, Homo sapiens
  misc_feature: GYAE6OF01CYN2Z.37.11.A11.1.454.CMB.1.raw
  modified_base (460)..(460): a, c, t, g, unknown or other
  misc_feature (460)..(460): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccgggtccctgaccgattcagtggcagcgggtctggacagattcactctcaccatcaacagcctgcaggctgaggatggtggacgtatttattactgtcagcagtattataatctcctcgacgttcgccaagggaccaaggtagaaatcaaacgactgngctgcacatctgtcttcatcctccncntctag

SEQ ID NO: 169162 - DNA, 563 bp, Homo sapiens
  misc_feature: GYAE6OF01CKGQX.37.11.A11.1.454.CMB.1.raw
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaacaataagaactacttagcttggtatcagcaagaaccagggcagcctacctaactgctcatttacgngggacatccgtacccgggacgtcccggggtcctgaccgtattcgagtggcgacggcgggtctagggactagtactttcactctacaccataccaacacgcctggacgacggctggaggatggtagtacgttaattttatactgtacagctaagtattaataactctccgtacgtcgtaccggaccgaagggtaccaaggtagaaactacgaaacgactggacggctacgaccactacttcgtacgttcttacgcttccctacccgctagttctaacg

SEQ ID NO: 169163 - DNA, 702 bp, Homo sapiens
  misc_feature: GYAE6OF01CW2XK.37.11.A11.1.454.CMB.1.raw
  modified_base (260)..(260): a, c, t, g, unknown or other
  misc_feature (260)..(260): n is a, c, g, or t
  modified_base (332)..(332): a, c, t, g, unknown or other
  misc_feature (332)..(332): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttaatacagctaccaaacaataagaactacttagcttggtatcagcaagaaaccnggcagcctactaaactctctattactaggcgataccgtacccggacggtccgggtcccgtcgtacgacttcnggtaggcgacggcgggtcgtcggacgacgtaacgtttctaacctctcaccaactaccaacaacgtacctcggacacgggcttgggaacggtagtgggttaggacggttaatttttaagttaacgttcgtcgaacgtcgttaaagtttaactttaaattaaacgttacccgttacccggttacccgggtaacgggttttaccgggaaccccggtaaaggggtaaaccccgtaaagggttacggtaaaaacttaccggaaaaccggttaaacgtggtacgggaccttacggaccctaaaccgtatttcgttaaccgttcctttaccgacctttacccgttacccccgacttaacgtccgtaagttaaacccc

SEQ ID NO: 169164 - DNA, 505 bp, Homo sapiens
  misc_feature: GYAE6OF01EJBZN.37.11.A11.1.454.CMB.1.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaaacaataagaactacttagcttggtatcagcaagaaaccaggcagcctactaaactgctctatttactggcatccgtaccgggngtcccgggtcctgacctatcagtgcagcggtctggacagtnttcactctacacataccaacacgctgcaggcctaggagatggtggacttattatactgtacagctaagttatataatctcgtacgacgttcgacgagacctaaggtagaactacaacgtacgtgcgtcngacantctctctactactctacccnctanctac

SEQ ID NO: 169165 - DNA, 512 bp, Homo sapiens
  misc_feature: GYAE6OF01AH1U7.37.11.A11.1.454.CMB.1.raw
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctctaaactgctcattacngggcatctacccgggagtccgggtcctgaccgtatcagtgcagcggtctggacagattcactcncacatcaacagcctgcaggctgaggatggtggacgtattttatactgtcagtctagttattaataatacctcctacgacgttccggaccgaagggacccaagggtcgaaatcgaaaacgctggtcgactgccacatctgtcttcacttccttacccgctagtctacg

SEQ ID NO: 169166 - DNA, 587 bp, Homo sapiens
  misc_feature: GYAE6OF01BW2GM.37.11.A11.1.454.CMB.1.raw
  modified_base (287)..(287): a, c, t, g, unknown or other
  misc_feature (287)..(287): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactgctcatttacgnggcacgtccgtacccggggaggtcccggggtcctggaccgtattcgaggtggcaggcgggtctgggacagtatttcactctcacatacaacacgcctgacgaggctaggaggagtggtcgggacttaatttactacgtgtacagtctaagttaattaataacttacctccctacggtaccgttacggaccgaacgggaccgtaagggtacgaaactacgaaacggtacgtaggtacggacctcggacctactatccgttacgtaccttctaccttccgttaccccactacgttctaaacg

SEQ ID NO: 169167 - DNA, 552 bp, Homo sapiens
  misc_feature: GYAE6OF01CUU33.37.11.A11.1.454.CMB.1.raw
  modified_base (373)..(373): a, c, t, g, unknown or other
  misc_feature (373)..(373): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactgctctatttactgggcatccgtacccgggagtcccggggtcctgaccgtattcgagtggcaggcgggtctgggacagtattcactctcaccatcaacngcctgcaggctaggagatggtgacgtatttattactgtcagctagtattaataatacctcctcggtacgttccggaccgaaaggggacctaaagggtacgaaatcgaaaacgtacgtgtcggactgacctacctattccgttgtcttaccgtacttcccttaccccgactctcgtaacg

SEQ ID NO: 169168 - DNA, 611 bp, Homo sapiens
  misc_feature: GYAE6OF01DBJ8R.37.11.A11.1.454.CMB.1.raw
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagacttgtttanacagctaccaaacaataagaactacttagcttggtatcagcaagaaaccaggcagcctactaaactgctctatttacgngggacatccgtaccgggacgtcccggggtcctggaccgattcgagtcggcaggtcgggtctgggactagtatttcactctacaccatcaacacgcctgacaggcctaggacggtatggtaggtacgttaattttaagttacgtgttacagtacctaagttaactttaattaaactacctcccgtaccggtaacgtttccgggaccgaaagggtaccgaaagggttacggaaactccgtaaaacgacgttggacgtactcggaacctacctagttcccgttgttaccttaccgtaccttcccgttaccccgacctattccgtaacg

SEQ ID NO: 169169 - DNA, 599 bp, Homo sapiens
  misc_feature: GYAE6OF01BF520.37.11.A11.1.454.CMB.1.raw
  modified_base (208)..(208): a, c, t, g, unknown or other
  misc_feature (208)..(208): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagacaagaaaccagggcacgcctacctaaactgactctatttacgtgggcactccgtacccgggagtcccggggtccctggaccgtattcgagtggcaggcgggtcgtgggacagtacttcactcncaccatacaacacgcctgcgaggctggaggtntggtgtactatttagtactgtacagtacgtagttaattactaacttaccgtcccgtacggtaccggttaccggacccgaagggtaaccaagggtacgaaactaccgaaaacgtacgtggtacgctacgaccctactaacgttccgttagttaccttaccgtacctttccccgttaccccgcttacgttcgtaaccg

SEQ ID NO: 169170 - DNA, 579 bp, Homo sapiens
  misc_feature: GYAE6OF01CY090.37.11.A11.1.454.CMB.1.raw
  modified_base (287)..(287): a, c, t, g, unknown or other
  misc_feature (287)..(287): n is a, c, g, or t
  modified_base (572)..(572): a, c, t, g, unknown or other
  misc_feature (572)..(572): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctcaacaataagaactacttagcttggtatcagcaagaaaccagggcagcctacctaaactgactctatttacgngggactagtccgtacccggggagtcccggggtaccctcggacccgatttccgaaggtcggcagggtccgggtcgtagggaccaggtatttcaactctacaccatacaacacgcctgacgacggctaggaggactggtggacgtatttatacgtgtacagactaagttattaactaacttactcccgtaccggtaccgttaccgggaccgaaacggggacctaaagggtacgaaataccgaaacgtacgtgtaggctagccacatctagtctcactcttcccgctntctaacg

SEQ ID NO: 169171 - DNA, 534 bp, Homo sapiens
  misc_feature: GYAE6OF01DLAJS.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggacagcctcctaaactgctcatttactgggcatccgtaccgggagtcccggggtccctgaccgattcagtggcagcggtctggacagattcactctcaccatcaacagcctgcaggctgaggtatggtggcgtatttatactgtacagctagtattataatctcctcgacgttcggacctaagggaccaagggtcgaaatcgaaaacgtactaggtcggactcgccaccgtattcctagtctttaccacttccccttcccgacctagttcctaacg

SEQ ID NO: 169172 - DNA, 649 bp, Homo sapiens
  misc_feature: GYAE6OF01AQ5ZY.37.11.A11.1.454.CMB.1.raw
  modified_base (380)..(380): a, c, t, g, unknown or other
  misc_feature (380)..(380): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactgctcatttacgtgggcactccgtacccgggacggtcccgggtccctgaccgattcagtggcaggccgggtcgtaggactagtactttcactctcaccatacaacncgcctacgcgaggctggaggtagtggtcggtacgtaattttatacgtgtacacgtactaagttaattaacttaacttacctacccgttaccggtaccggttaccggacccgtaaacggggtaaccgtaaagggtacggtaaaacgtaaccgaaaaccggtaacgttacgggtacgggtacctacggaccctaaccctacgttacccgttcgttaccctttaccgtacccgttacccgtttacccccgaccttacgttccgttaaaccgg

SEQ ID NO: 169173 - DNA, 596 bp, Homo sapiens
  misc_feature: GYAE6OF01DK3QK.37.11.A11.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccagggcagcctacctaaactgctcatttacngggcatcgtacccgggacgtccgggtccctgaccgattcagtgcagcgggtctggacagtattcactctcaccatcaacagcctgcacggctgagagtgtggtacgtatttattacgtgtcagtactagttatttaagtaactacttccgtaccgtacgtttacgggacccgtaaaggggaccctaaagggtacgtaaacgtacaaaaccggtaacttaggtcggtacgtacggacctacctaacgtttcctacggtttcctttacccgtacgtttacccttacccccggtacctagttcccgttaaacgg

SEQ ID NO: 169174 - DNA, 529 bp, Homo sapiens
  misc_feature: GYAE6OF01B59WK.37.11.A11.1.454.CMB.1.raw
  modified_base (212)..(212): a, c, t, g, unknown or other
  misc_feature (212)..(212): n is a, c, g, or t
  modified_base (403)..(403): a, c, t, g, unknown or other
  misc_feature (403)..(403): n is a, c, g, or t
tcagtagtgtagatcacgaccggtgctcgatttagctacgactgcgaggggcagcaagatggtgttcgccacgacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcaataaaccagggcagcctacctaaactgctctatttactggcatcgtacccgggagtccggggtcctgaccgtattcagtggcaggcggtctggacagtatttcactctcaccatcaacagcctgcaggctgagatgtgctatttatactntcagctagtattataactctcctacgacgttacgaccgaagggtaccaagggttagaaacttacgaaacgtacgtggtcgactagccacacttctgtccttacacttcctacccgctacttctacg

SEQ ID NO: 169175 - DNA, 612 bp, Homo sapiens
  misc_feature: GYAE6OF01CD7Q8.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaacttacttagcttggtatcagcaagaaaccagggcagcctacctaaactgctctatttactgggcatccgtacccgggaggtcccggggtccctgaccgtattcagtggcaggcggtcgtgggacagtattcgactctccgaccactcaaaccacgcctgcgaggctgaggatggtggtcgtaatttacgtactgtacagtactagttattaataacttacctcccgttaccggtacggttaccgggaccgtaaacgggggtaacctaaaggggtacgtaaactacgaaaaaccggtacgtaggtcggacctacggactaaccctagttccgttacgttaccgtttaccctaacgttcccttacccccgcctagttcctaaccgg

SEQ ID NO: 169176 - DNA, 482 bp, Homo sapiens
  misc_feature: GYAE6OF01A1ZK4.37.11.A11.1.454.CMB.1.raw
  modified_base (446)..(446): a, c, t, g, unknown or other
  misc_feature (446)..(446): n is a, c, g, or t
  modified_base (477)..(477): a, c, t, g, unknown or other
  misc_feature (477)..(477): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccggagtccggggtccctgaccgattcagtggcagcggtctggacagattcactctcaccatcaacagcctgcaggctgagatgtgcgtatttatactgcagcagtatatatactcctcgacgtcgcaagggaccaggtgaatcaaacgatgngctgcacatctgtcttcactcccttccgctntcgta

SEQ ID NO: 169177 - DNA, 594 bp, Homo sapiens
  misc_feature: GYAE6OF01CRJ5O.37.11.A11.1.454.CMB.1.raw
  modified_base (288)..(288): a, c, t, g, unknown or other
  misc_feature (288)..(288): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactcgctctatttacngggccatcctacccggggagtcccggggtccctgaccgatttccgagtggcgaggcgggtctggacaggtattcactctcacatcaacacgcctgcgaggtctaggaggattggtacggtacgttattttagttaacgtgtaccaggtctaagttattaataacttacctcccgtacggtaccggttcgggacccgtaaggggaccctaaagggtacggaaaactcgaaaacgtacgttgtaggctacggccaaccttatccttcgttccttacgtaacttcccgtacccgccctagttcctaacg

SEQ ID NO: 169178 - DNA, 571 bp, Homo sapiens
  misc_feature: GYAE6OF01DNU7O.37.11.A11.1.454.CMB.1.raw
  modified_base (285)..(285): a, c, t, g, unknown or other
  misc_feature (285)..(285): n is a, c, g, or t
  modified_base (378)..(378): a, c, t, g, unknown or other
  misc_feature (378)..(378): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctactaaactgctcatttacngggcatccgtaccgggagtccggggtccctggaccgtattcagtcggcgagcgggtctggacagtattcactctcaccatacaacagcctgcnggctgaggatggtagcgtatttatactgtacagtcagttattataactacctcctaccgtacgttcggaccgtaaaggggacctaagggtaggaaactacaaaaccggaacttggtacggctacggacctaacctacttccgttacgttccttacctactttaccccttacccccggacctattccttaaacg

SEQ ID NO: 169179 - DNA, 585 bp, Homo sapiens
  misc_feature: GYAE6OF01AM22V.37.11.A11.1.454.CMB.1.raw
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccngggcagcctacctaaactgctcatttacgngggcactcgtacccgggagtcccggggtccctgaccgtattcgagttcggcaggccgggtctagggacagtactttcgactctccacctatccaacacgcctgcgaggctaggaggtatggtacggtcgtattttagttactgtacagtacgtagttattataacttctacccgtcgtacggtttaccggaccgtaacggggacccgtaagggttacgaaactacgaaaacggtactggtacggctacgccaaccagttctgttaccttcgtaccttccttaccccgctactcgtaacg

SEQ ID NO: 169180 - DNA, 615 bp, Homo sapiens
  misc_feature: GYAE6OF01EOWBR.37.11.A11.1.454.CMB.1.raw
  modified_base (287)..(287): a, c, t, g, unknown or other
  misc_feature (287)..(287): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataagaactacttagcttgtatcagcaagaaaccaggcagcctacctaaactgctctatttacnggcatcgtacccgggagtcccggggtcctgaccgtattcagtcggcaggccgggtctgggactagtactttcactctccacctataccaacacgtcctgacgagggctaggaggagttggtgggtactaattttacgttacgtcggtacagtaccgtaagtttaattacttaaacttaccctcccgtaccgtacgttaccgggaccgtaaaggggtaacctaagggtagtaaacgtacgaaacggtaacgtgggtacgacgtacggcctaaccgtattccgtacgttaccttaccgaacttcccttaccccgactacgtccgttaacg

SEQ ID NO: 169181 - DNA, 667 bp, Homo sapiens
  misc_feature: GYAE6OF01CZNVG.37.11.A11.1.454.CMB.1.raw
  modified_base (212)..(212): a, c, t, g, unknown or other
  misc_feature (212)..(212): n is a, c, g, or t
tcagtagtgtagatcacgaccggtgctcgatttagctacgactgcggaggggcagcaagatggtgttgcagacccaggtcttcatttctctgttgctctggatctctggtgcctacggggacaccgtgatgacccagtctccagacctcctggctgtgtctcgtgggcgagacggcctccatcaactgcaacgtccagccagtactgtttanacagcctacaataataagaacttacttagtcttggtatcgagacaagaaccgaggacacgtacctactaactgactacatttacgcggccacgtccgtaccggacgtccgggtacctcgaccgttatccgaggtcgccgaggtccgggtacgtacggaacctaggttacttcgacgttcctacctacctataccgactacgtccgtacgacgacgggtctaggagtagttcggtaggtaccgtttattttaacgtcgtagtactagtacgttaattaactttaattaccgttacgtcccggttacggtaaccggttaccgggaaccgtaaacggggtaccgtaaagggtacgtaaacgtaccgaaacggtcgttggaccgtaccgtacgtaccacttacgttccgttacgttacccttactacccgtttcctacccgtaccttatcggttaaccg

SEQ ID NO: 169182 - DNA, 606 bp, Homo sapiens
  misc_feature: GYAE6OF01CH92S.37.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcaagaaaccagggcagcctacctaaactgctcatttacngggcatctacccgggagtccgggtcctgaccgattcagtggcagcgggtctgggacagtattcactctacacatcaacagcctgcagctagaggatgtggctatttatacgtgtacagtctaagtatttaataacttactcccgttacggtaaccgttaccgggacccaaaggggtaccctaaagggttacgaaaacgttacccgaaaaacggtaacgttcggtagggtacccttaaggaccctaacccgtaacttccgttacggttcctttaccgtacctttaccccgttcccccgacttaaacgttccgttaaaccgg

SEQ ID NO: 169183 - DNA, 494 bp, Homo sapiens
  misc_feature: GYAE6OF01AWFGO.37.11.A11.1.454.CMB.1.raw
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (466)..(466): a, c, t, g, unknown or other
  misc_feature (466)..(466): n is a, c, g, or t
  modified_base (484)..(484): a, c, t, g, unknown or other
  misc_feature (484)..(484): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctctaaactgctcatttactgggcatctacccggagtccgggtcctgaccgnttcagtgcagcggtctggacagattcactctcaccatcaacagcctgcaggctgagatgnggcatttatactgtcagcagtattanaatctcctcgacgttcggccaagggtaccaagggtgaaactcaaaacgactgtcggctgcacatcngtcttacatccgtacccncctatctaag

SEQ ID NO: 169184 - DNA, 516 bp, Homo sapiens
  misc_feature: GYAE6OF01C1FWP.37.11.A11.1.454.CMB.1.raw
  modified_base (288)..(288): a, c, t, g, unknown or other
  misc_feature (288)..(288): n is a, c, g, or t
  modified_base (509)..(509): a, c, t, g, unknown or other
  misc_feature (509)..(509): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataagaactacttagcttggtatcagcaagaaaccagggcagcctacctaaactgctcatttacngggcatcgtaccgggagtccgggtcctgaccgattcagtggcagcggtctgggacagtattcactctcaccatcaacacgctgcaggctaggagtatgtagactatttatactgtacagctagtattataatactcctcgtacgttacggaccgaagggaccaaggtagaaactcaaacgtactgtggctgccactatctgtcttcactccttacccgctntcgtacg

SEQ ID NO: 169185 - DNA, 571 bp, Homo sapiens
  misc_feature: GYAE6OF01CDK0Y.37.11.A11.1.454.CMB.1.raw
  modified_base (284)..(284): a, c, t, g, unknown or other
  misc_feature (284)..(284): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctggcgagagggcctccatcaactgcaagtccagccagactgttttatacagctaccaacaataagaactacttagcttggtatcagcaagaaaccaggcagcctacctaaactgctcatttacngggctatccgtacccggggagtccgggtccctgaccgattcaggtggcgaggcggtcgtggacagtacttcgactctccaccatcaacagcctgcaggctggacgtgtgtggcttatttatactgtacagtactagttattataactaccgtcctccgtacgttaccggacgaaacgggtacctaaagggtacaaacgtacgaaaacgtacgtggtacgctacggacctacctagttcgttccgtctttacctacttcccctttaccccgccttaagtcttaaaccg

SEQ ID NO: 169186 - DNA, 907 bp, Homo sapiens
  misc_feature: GYAE6OF01EC0HB.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtcctccagacctccgtggctgtgtctcgtgggcgaggcggccctccatacaactcgacgaacgtccacgaccagtacgttttagtttttaacacacgtcctaaccaaaactaaataaacgtaaccttacttagtcgtttaggtactacgagacgaaacgaaaccggagggaccacgtacccttaacctaaacgtcgtaccttacttaacgtttacggtcggactacgttacccgggtaaccccggggtacgggttccccgggttaccctacggtaaccgttacttacgaggtcggacgtacgggtccgggtacgtacggacgtagttacttccaaccgtcctaccgaactactaccgaaaccgtcgtccgtaggacggtacggtcgtaacgggaggttacggttcgggtacgggttaactttaaacgttttaacgttacggttcggtaaccgtaacggttaccttaaagggttttaactttaaaacgtttaaccccgtttaccccggtttaccccggttaacccgggtaaccccggggttttaaccccgggaaaacccgggtaaaaccgggggtaaacccgggttaaacggggtttaaaaccgggtaaacccttaaaaccggggtaaaaaccgttaccgggtttccggggtaaccgggttaccctaaccggtaccccgttaacgttacctttaccggttccgttttaaccccttaacgtttaccccgtttaccccccgtaccccttaaccgttaaccgttcgttaaaacccg

SEQ ID NO: 169187 - DNA, 501 bp, Homo sapiens
  misc_feature: GYAE6OF01BM6YS.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctcaacaataagaactacttagcttggtatcagcagaaaccagggcagcctactaaactgctcatttactggcatcgtaccggagtccgggtcctgaccgattcagtggcaggcggtctgggacagtattcactctcaccatcaactagcctgcaggctggagatggtggacgtatttatactgtcagctagtatatatactcctcgagttcgacaagggtaccaaggtgaaactcgaaacgactgtgctagcactatctcgttctctatcccttaccgctatccgtag

SEQ ID NO: 169188 - DNA, 493 bp, Homo sapiens
  misc_feature: GYAE6OF01B2465.37.11.A11.1.454.CMB.1.raw
  modified_base (362)..(362): a, c, t, g, unknown or other
  misc_feature (362)..(362): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctctaaactgctcatttactgggcatcgtacccgggagtccgggtccctgaccgattcagtggcagcgggtctggacagatttcactctcaccatcaacngcctgcaggctgagatgtggctatttatactgtcagctagtattataatactcctcgtacgttcggccaagggaccaaggtgaatcaaagactgtgctgcacatctgtcttcacttcctccgccatctacg

SEQ ID NO: 169189 - DNA, 621 bp, Homo sapiens
  misc_feature: GYAE6OF01B1UZ0.37.11.A11.1.454.CMB.1.raw
  modified_base (210)..(210): a, c, t, g, unknown or other
  misc_feature (210)..(210): n is a, c, g, or t
  modified_base (589)..(589): a, c, t, g, unknown or other
  misc_feature (589)..(589): n is a, c, g, or t
  modified_base (615)..(615): a, c, t, g, unknown or other
  misc_feature (615)..(615): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggagggcctccatcaactgcaagtccagccagactgtttanacagctacaacaaataagaactacttagcttggtatcagacaagaaaccaggcacgcctactaaactgctactatttacgtggactacgtccgtacccggggtacgtcccggggtaccctggaccgtagttccgagtcggcaggcgggtacgtgggacctagtactttccactcgtacaaccagtaccaaacgcgcctacgcgaaggtctaggaggtagtcggtaggtacgttaattttaacgtaccgtgtaccgagtacctaagtttaacttaacgtaacttaccgtacccgtaccggtacggttaccggacccgtaaacgggtaccgtaaaggtacggtaaactaccgaaaacgtacgtggtacgctacgcgtaacnttctactcttcacttcctacccactntcgtac

SEQ ID NO: 169190 - DNA, 647 bp, Homo sapiens
  misc_feature: GYAE6OF01BYDJ4.37.11.A11.1.454.CMB.1.raw
  modified_base (363)..(363): a, c, t, g, unknown or other
  misc_feature (363)..(363): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtatccagactccctggctgtgtctctgggcgagagggcctccatcaactgcaagtccagccagactgttttatacagctccaacaataagaactacttagcttggtatcagcaagaaaccagggcacgcctacctaaactgctctatttactgggcagtccgtacccgggagtcccgggtcctggaccgtagttcagtggcaggcgggtcgtggacagtattcactcncaccatccaaacacgcctcgacgaggtccgtaggaaggtagtcggtagggaccgttaattttaacgttacttggtaccaaggtcctaagtttaatttaagttaaactttaccgttacccgttacccggtaacggtttcccggaaccggtaaacgggtaacccgtaaagggttacggaaaacgttaccgaaaacggtaacgttcggtacggaccttacggacctaccctaagttccgttagttcccgttactaccgttacccttaccccgcttaagtcttaaacg

SEQ ID NO: 169191 - DNA, 667 bp, Homo sapiens
  misc_feature: GYAE6OF01ECWVY.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagaggcctccatcaactgcaagtccagccagactgttttanacagctaccaaacaataaagaactacttagcttaggtatcagacaagaaaccagggcacgacctacctaaactgacctactatttacgtgggctacgtccggtaacccggggacggttccccggggtccctacggaccgtagttcgaaggtggacgagggtccgggtcgtacgggacgtagtactttcgaccttcctaccaacctataccaaacgcgtccgtagacgtagggcgtaggaggtagtgggtagtaccgttaattttacttacgtggttacaacgtacgtaagtttattaaagttaacctaccgttcccgtaccggtacgttacccggaccgaaacgggtaaccgtaagggtaacgaaactaccgaaaacgtacgtggtcggacctagaccctaactgttcccgttagttcccttaccgtactttccccgttaccccgattccttcgtaacg

SEQ ID NO: 169192 - DNA, 671 bp, Homo sapiens
  misc_feature: GYAE6OF01D2DOI.37.11.A11.1.454.CMB.1.raw
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
  modified_base (653)..(653): a, c, t, g, unknown or other
  misc_feature (653)..(653): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttanacagcctaccaaacaataagaacttacttagcttaggtatcagcaagaaaccgagggcacgcctacctaaactgactcaatttcgngggcacgtccgtacccgggaggtcccgggtccctgaccgtattcgaggtcggcgacggcgggtcgtggactacgtacttcgacctctacacctataccaacgagtccctgtaccagggtccttaggacggtattggtacgggtacttaacttttacgttaacgttgtacctaggtacttaagtttaacttaacttacgtaccctttcccgtaccggtaccggtttacccggaaccggtaacggggtaaaccgtaagggtaacggtaaactaaccgaaaaccggttagtggtacggtactacgacctaaccgtactttccgtacgttaccttaccgtaacgtttccccgttaccccnccttaattcccgtaaacg

SEQ ID NO: 169193 - DNA, 803 bp, Homo sapiens
  misc_feature: GYAE6OF01D0EJG.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccctggctgtgtctcgtgggcgagagggcctccatcaactgcaagtccagccagtacttgttttaactacagcctaccaaactaaataacgaaccttacttagtcgtttaggtactacgagacaacgaaacccgagggcacgtccctaacctaaactcgaccttactaacttttacgagggacctaacgttacccggtaacccggggacggttccccggggtacccttcggacccggtatttccgaaggtcggaccgagggtcgggtacgtagggactagtactttccacttcctacccaactactacccaaacgacgtcccgttacgaccgtacggggtacctaggggacggtaaggttagggtacggggttactttaacttttttaacgttaaccgttcggttaccgaaggttaccgtaaagttttaaactttaacgtttaaaccgttacccctttacccgttaccccgggtaaccggttttaacccgggaacccgggtaaaccggggtaacccggttaaagggtaacgtaaaacttacccggaaaacggtaccggttaggtcggtacctacggacccctaccttacgtttccttacggtttacccttacgtaccctttaccccgttacccccgacttacgttccgtaaaccg

SEQ ID NO: 169194 - DNA, 618 bp, Homo sapiens
  misc_feature: GYAE6OF01BT3TG.37.11.A11.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
tcagtagtgtagatcacgaccggtgctcgatttagctacgactgcaggggcagcaaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgtttanacngctcaacaataacgaactactagcttgtatcagcaacgaaaccgngggcagcctacctaaactgactcagtttacngggctacgtccgtacccggggagttcccggggtccctgaccgtattcgagtcggctaggcgggtctggactagtcttccgactcctcacctatacaactcgcctgctaggctaggagagtggtacggacgtaattttactacgtgtcagtacgtagttatataactctccgtcgtacgttcgaccgaaggtaccgaaggttacgaaacttaccgaaaacgtacgttacggtcgtaccgtacggaccctaaccgtaagtttcccgttacggttaccctttacccgtaaccgtttcccccgttaacccccgtcctaacgtttccgttaaccg

SEQ ID NO: 169195 - DNA, 873 bp, Homo sapiens
  misc_feature: GYAE6OF01D0XFG.37.11.A11.1.454.CMB.1.raw
  modified_base (296)..(296): a, c, t, g, unknown or other
  misc_feature (296)..(296): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttggtatcagacaagaaaccgagggacacgacctacctaaactcgctactatttacgngggacctaacgttccgtaaccccgggggacggttcccggggtacccttacggaacccgtagttccgaaggttcggacgacgggtccggggtacgtacgggaactacgtaatttccgactctacaacccataccaaacgacgaccgtggacgaggggtcctaagggacggtaagttgggtacggggttaccttaagtttttaaccgtacgttacggtacgtaaggtaccgttaaaggtttaaacttttaacgttaaaccgtttaaccccgtttaccccgggttaaccccgggttaaacccggggttttacccggggaaacccccggttaaaaacgggggggtaaaccccgttaaaaaggggggttttaaaccggggaaaaacctttaccccggaaaaaaacccgggtaacccgggtttacggggttaccggtaacccgtttaaaccgggaaaccccgttaaaccccgttacgttttaccccgtttaaccgggtttaccccttttaacccccggtaacctttttaccccccgttaccccccgggtaaaccccttaagggtttacccgtttaaaacccgg

SEQ ID NO: 169196 - DNA, 560 bp, Homo sapiens
  misc_feature: GYAE6OF01AOEC2.37.11.A11.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctacctaaactgctcatttacngggcatcctacccgggagtccgggtcctgaccgattcagtggcgagcggtctgggacagattcactctcaccatcaacacgcctgcagctgaggatgtggcgtatttacttactgtcagtcagtaatttacaacttacctccgttacgaacgtttccggacccgtaaagggtacctaagggtacgaaactacgaaaacgtaacgtcggtacggcgtcgacctacctagtccgttagtcctttactacgttcccttaccccgcctattccgttaacg

SEQ ID NO: 169197 - DNA, 706 bp, Homo sapiens
  misc_feature: GYAE6OF01DEU8W.37.11.A11.1.454.CMB.1.raw
  modified_base (208)..(208): a, c, t, g, unknown or other
  misc_feature (208)..(208): n is a, c, g, or t
  modified_base (287)..(287): a, c, t, g, unknown or other
  misc_feature (287)..(287): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctctgggcgagaggcctccatcaactgcaagtccagccagactgttttanacagctacaaacaataagaactacttagcttggtatcagcaagaaccagggcagcctacctaaactgctctatttacgngggcagtccgtaccggggacgtcccggggtcctggaccgtattcgaggtgcgaggcgggtctgggactagtacttcactcgtcaaccacgtacaacgacgtccctgaccgagggcgtaggacgggtagttgggtacgtaccggtttaattttaagtttaaccgttcgtaccgtaaggtccttaaaggtttaaactttaaacgttaacgtttaaccccgtttacccggttaccccggttaaccggtttaccccgggaacccgaaaccgggggtaaccgtaaagggttacggtaaaactaaccggtaaaacgtaaccgttggtaccgggtaccgtacggtaccctaacccgttaagttcccgttacggttaccctttcgtaaaccgtttcccttaccccggactaaccgttcgttaaaccg

SEQ ID NO: 169198 - DNA, 558 bp, Homo sapiens
  misc_feature: GYAE6OF01B8SYV.37.11.A11.1.454.CMB.1.raw
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggccacgatcaactgcaagtccagccggagtgtttatacaactccaagaataagagttctttagcttggtaccagcaagaaaccacgacagcctcctaagctgctcgttactggcctctaccgggatccggggtcctgaacgattcagtggcggcggtctgggacagattcactctcaccatcagcagcctgcggntagaagntgtgcgtttatactgtacagctagtattatcgttactcctcactagtttcggccgtaaggggacctaagccgttaggacgtactcgacaacgtaacgtggtacggcctaggcctaaccgtattccgtcgttcctttacgtaaccttcccgtttccccgacctaacttccgttagtaacttacccg

SEQ ID NO: 169199 - DNA, 584 bp, Homo sapiens
  misc_feature: GYAE6OF01A185Y.37.11.A11.1.454.CMB.1.raw
  modified_base (283)..(283): a, c, t, g, unknown or other
  misc_feature (283)..(283): n is a, c, g, or t
  modified_base (369)..(369): a, c, t, g, unknown or other
  misc_feature (369)..(369): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatccgtaccgggacgtcccggggtccctgacccgattcagtcggcaggcgggtctgggacagtattcactctcacatcaacngcctgcaggctggagatgtggcgtatttatactgtcagtctaagttattactaataccttcccgtacgtaccggtttaccggaccgtaaacggggtacccgaaagggttacgaaaactaccgaaaacggtaacgttggtaccggacgtacgcctaaccctagttcccgttagttcccttactacttccccgttacccccgcttatcccgttaacg

SEQ ID NO: 169200 - DNA, 706 bp, Homo sapiens
  misc_feature: GYAE6OF01EHEVU.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataaagaactacttagcttggtatcagacaagaaccaggcagcctacctaaactgctactatttacgtgggcacgtccgtacccgggaggtcccgggtccctagaccgtattcgagtggcaggtcgggtcgtaggactagtactttcgactcctacaacctactaccaaacgacgccctggacgtaacgggcgttagggaaggttagtcgggtagggtaccgttaaatttttactaccgttgtaccgtaaggtacctaaagtttaacgtttaaacttaaacgtttaccccgttacccgttacccgggtaaccgggtttacccgggaacccggtaaacggggtaacccgtaaagggttaacggaaaacttaaccggaaaaccgtaaaccggttggtaccggaccgtacgaacccgtaacctaacttccgtcgtttaccttacctaacctttccccgttaaccccgccttaacgttccgtaaacg

SEQ ID NO: 169201 - DNA, 498 bp, Homo sapiens
  misc_feature: GYAE6OF01C57HN.37.11.A11.1.454.CMB.1.raw
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcaagaaaccagggcagcctacctaaactgctcatttactgggcatccgtaccgggagtccggggtccctgaccgtattcagtggcagcgggtctggacagtatttcactctcaccatcaacagcctgcaggctgaggatgtggctatttatactgtcagctagtattataatcctcctcgacgttcggaccgaagggccaaggtgaaatcaaacgactgngcngcacatctgtcttcattcctccgctntcta

SEQ ID NO: 169202 - DNA, 525 bp, Homo sapiens
  misc_feature: GYAE6OF01AMKEY.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccggggtccctgaccgattcagtggcagcgggtctggacagatttcactctcaccatcaacagcctgcaggctggagatgtggcgtatttatactgtcagcagttattataactactcctaccgacgttaccggccgaagggacccaagggtacggaaactacgaaacgactgtacggctagcctacgattcgtcgttcttcacttccttacccgctatctacg

SEQ ID NO: 169203 - DNA, 738 bp, Homo sapiens
  misc_feature: GYAE6OF01BW57J.37.11.A11.1.454.CMB.1.raw
  modified_base (211)..(211): a, c, t, g, unknown or other
  misc_feature (211)..(211): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttanacagctaccaaacaataagaacttacttagcttggtatcagacaagaaaccagggccacgccctacctaaacgtgacttactactttacgtgggacctaacgttcccggtaccccggggtacggttccccggggtccctcggaacccgtatttcgaggttcggccgaggtccgggtcgtagggacctagtactttccacttcgtaccaacctataccaactcggtaccctggaccgtagggtccgtaggtacggtagttggtacgggtacgtttaagttttaacttacgtcgttaccaggtacttaaggttaactttaacgttaaacttacccgttaccgttacccgggtaacggtttacccgggaacccggtaaacggggtaaccccgtaaaggggttaaccgtaaacgttacccgaaaaaccggttacgttacgggacggtaccgtacggtacccgtaacccgttaacgttccgttcgttacccttacgtacccttacccgtttaccccgactacttccgtaacg

SEQ ID NO: 169204 - DNA, 667 bp, Homo sapiens
  misc_feature: GYAE6OF01BDAOC.37.11.A11.1.454.CMB.1.raw
  modified_base (215)..(215): a, c, t, g, unknown or other
  misc_feature (215)..(215): n is a, c, g, or t
  modified_base (304)..(304): a, c, t, g, unknown or other
  misc_feature (304)..(304): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggacggccctccatcaactgcaagtccagccagtacttgttttanacagcctaccaaacaataacgaacttacttagcttaggtatcagacaagaaaccgagggacacgcctacctaaactgctctatttacgngggctacgtccggtacccggggacggttcccggggtccctaggaccgtattcgaggtcggacgacggtccgggtcgtagggactagtactttaccgactcctacacctactaccaaacgcgtcctggacgagggtctagggaggtagttgggtacggtactttaagtttacttaccgtgtactaagtactaagtttactttaactaacgttacccgtacccgttacccggtacggttacccggaaccggtaacggggtaaccgtaagggtacgtaaacgtaaccgaaaacggtacgttggtacgaccgtacgaccactacgttcgtacgttccttactacgttccctaccgctagtcgtaacg

SEQ ID NO: 169205 - DNA, 666 bp, Homo sapiens
  misc_feature: GYAE6OF01BLDF7.37.11.A11.1.454.CMB.1.raw
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaaataagaactacttagcttggtatcagcaagaaaccaggcacgcctacctaaactgctctatttactgggcagtccgtacccgggacgtccggggtcctggaccgtnttcgagtggcaggccggtcgtgggacagtactttcactctacaccataccaaacncgcctgcgaggccttagggaggattcggtggtacgttaattttacttactggtacaaggtctaagtttattaacgttaaacttacccgttacccgtaccggtaaccggtttaccgggacccgtaaacggggtaaccctaaaggggttacgaaaacgttaccgaaaacggtaaccggttaggttaccggacgttacggaaccctaacccgttacgttccgtttaccggttacttacctaaccgtttccccttaccccccggacttacgttccgttaaaccgg

SEQ ID NO: 169206 - DNA, 612 bp, Homo sapiens
  misc_feature: GYAE6OF01CMW90.37.11.A11.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagagggcctccatcaactgcaagtccagccagactgtttanacagctacaanaataagaactactagcttggtatcagcaagaaaccaggcagcctacctaaactgctacatttacgtgggacagtccgtaccgggacgtcccggggtcctggaccgattcgagtggcgaggcgggtctgggacagtactttcactctcaacatacaacacgcctgcaggctaggaggatggtaggacgttaatttatactgtacagtactaagttattaactaactaccttacccgtaccggtaccgtttaccggaccgaaaggggtaccgtaaagggttaggaaaaccttacgaaaacgtacgtggtacggtactacggaccgtaacctattcccttaggttaccctttacgtaccttacccctttacccggaccttaaacgttcgttaacg

SEQ ID NO: 169207 - DNA, 749 bp, Homo sapiens
  misc_feature: GYAE6OF01CVSRC.37.11.A11.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctcctggctgtgtctcgtgggcgagacggcctccatcaactgcaagtccagccagtactgtttanacagcctacaaacaaataagaacttacttagcttaggtatcagacaagaaacgagggacacgcctactaaactcgactactatttacgngggactacgttccggtacccggggacggttcccggggtccctacggaccgtagtttcgaggttcgggaccgtacgggtccggggtcgtacgggaactaggttacttccacgtcctaccaccaactaccgaacgtacgtccgtacggacggtacggtcgtacggtaaggtagtcgggtacggtaccgtttaatttaacgttacgttacgtacgtacgtacgttaaggttaatttaacgttaaccttaccgttacccgttaaccggttaccgggttaccggaaccggtaacgggtaaccggtaaagggttaaccgtaaaacgtaccggtaaaaccgtacggttacggtacggttaccgacgtacccgtaacttaccgttccggtttaccgttacccgtttaccgtaacccgtttaccccgttaccccgacccttaagttacccgttaaaccg

SEQ ID NO: 169208 - DNA, 581 bp, Homo sapiens
  misc_feature: GYAE6OF01EEB98.37.11.A11.1.454.CMB.1.raw
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (349)..(349): a, c, t, g, unknown or other
  misc_feature (349)..(349): n is a, c, g, or t
  modified_base (381)..(381): a, c, t, g, unknown or other
  misc_feature (381)..(381): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttggtatcagcaagaaaccagggcacgccctacctaaactgctcatttacgngggcagtccgtacccgggaggtcccggggtccnggaccgtatcaggtggcaggcgggtntggacagtatttcactcctacaccatccaacncgcctgcgaggtcgtggaggagtggtggacttaatttattacgtgacagtctaattattaataacttcctcccgtaccggtaaccgttcggacccggaaagggaccgtaaagggtcgaaactacaaacgtatggtggaccttacgcctaacgtctcgttcgttccttactacttcctaccccggcttagtccgttaaacg

SEQ ID NO: 169209 - DNA, 542 bp, Homo sapiens
  misc_feature: GYAE6OF01CS7AN.37.11.A11.1.454.CMB.1.raw
  modified_base (378)..(378): a, c, t, g, unknown or other
  misc_feature (378)..(378): n is a, c, g, or t
  modified_base (518)..(518): a, c, t, g, unknown or other
  misc_feature (518)..(518): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctccaacaataagaacttacttagcttggtatcagcaagaaaccagggcagcctacctaaactgactctatttactgggctatccgtacccgggagtcccgggtccctggaccgtattcagtggcgaggcggtctgggacagtatttcactctcaaccatcaacngcctgcagctggacgattggaggtacttagtttacttctgtcagtctaagtattataactctaccgtcgacgttcgacgtaagggaccaaggtacgaatcgaaaacgtcgtgtcggctagaccacctatcctgtccttcncttcccttccgactgttcgtaacg

SEQ ID NO: 169210 - DNA, 704 bp, Homo sapiens
  misc_feature: GYAE6OF01EX68E.37.11.A11.1.454.CMB.1.raw
  modified_base (131)..(131): a, c, t, g, unknown or other
  misc_feature (131)..(131): n is a, c, g, or t
  modified_base (428)..(428): a, c, t, g, unknown or other
  misc_feature (428)..(428): n is a, c, g, or t
tcagtagtgtagatcacgaccggtgctcgatttagctacgactgcaggggcagcaagatggtgttgcagacccaggtcttcatttctctgttgctctggatctctggtgcctacgggggacaccgtggtanacccacgtcgtccacgactccctcggcgtcgtgtctctgggcggagagggccgtccactactaactacgcgaacgtaccgacgaccacgaacgttacgtttttagttaacacgcctacctaaaccaaataaagtaaacctaactttagtcgttcggttagtacacgacacgaaaaccgaacgggcgacgacctccctaaactagctccatttaacttgggcaactccgttacccggggacggtccggggttccccgtgaccggatttcacggtagggcgaggcgggtcgtggacganagtttcactcctcaaccatcaaaccagcctgcgacggcgttgaagggactggtcggacgttattttaattacgtgtacgagtctaagttaatttaataactaccttcccgaccggtacggtttccgggaccgaaacggggaccgtaaagggtaggtaaaactaccgaaaccgtaaacgttgtcgggtacctacgtacccgaaccctaagttccttcggttccctttaccgacttaccccgttttcccccggaaccctaatttacgtcggtaaaacc

SEQ ID NO: 169211 - DNA, 689 bp, Homo sapiens
  misc_feature: GYAE6OF01D0GAU.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaaataagaactacttagcttggtatcagacaagaaaccgaggcacgtcctacctaaactcgctactatttacgtgggctacgtccgtacccggggtacggtcccggggtccctcggaccgtattcgaggtcggacgacgggtcgggtcgtacgggactaggtactttccgactctacaaccataccaacgtacgtccgtagccgagggtcgtaggaagggtagtgggtacggtacgttaattttaacgttacgttcggtacagtactaagttaactttaactaacgttaccttcccgtaccggtacgggtttacccgggacccgtaaacggggtaaccgtaagggtaacggtaaacgtacgtaaaaccggtacgtcggtacggaccttacggaccctacctagttccgttcggttaccttaccgtacctttaccccgttaccccgtaaccttacgttccgttaaccg

SEQ ID NO: 169212 - DNA, 556 bp, Homo sapiens
  misc_feature: GYAE6OF01BPWIO.37.11.A11.1.454.CMB.1.raw
  modified_base (383)..(383): a, c, t, g, unknown or other
  misc_feature (383)..(383): n is a, c, g, or t
  modified_base (524)..(524): a, c, t, g, unknown or other
  misc_feature (524)..(524): n is a, c, g, or t
  modified_base (547)..(547): a, c, t, g, unknown or other
  misc_feature (547)..(547): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctccaacaataagaactacttagcttggtatcagcagaaaccagggcagccctacctaaactgctcatttacgtgggctactccgtacccggggaggtcccggggtccctggacccgtattcgaggtggcaggcgggtcgtgggacagtatttcactctcacatacaacngcctgcaggctaggaggtagtggtgggacgttatttagttactggtcagactagtaattataactcctaccgtcgtacgttccggaccgtaagggaccgaaggtacgaaactacgaaaacgcgttggtcgcgtagcctacntctcgtcttctacttccctaccnctgtctacg

SEQ ID NO: 169213 - DNA, 721 bp, Homo sapiens
  misc_feature: GYAE6OF01DN9VO.37.11.A11.1.454.CMB.1.raw
  modified_base (301)..(301): a, c, t, g, unknown or other
  misc_feature (301)..(301): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccacgtctccagactccctcggctgtgtctcgtgggcgagacgggcctccatcaactcgcaagtccagccagacttgttttactacacgtcctaccaaacaataacgaactacttagcgtttaggtactacagacaacgaaccgagggaccaccgtacctccttaaacgngtactacgtactttacgtacgggtacctacggtcccggtacccgggtacggtcccgggtacctacggaccgtagttacgagggtcggacgtacgggcgggttacgtacggtacacgttactttaccacgttctaccaaccgtacttaccgaaccacgtaccgtaggacgtacgggtacgtacggaagttaacgttgtacggttacttaagtttactaacgtacgacgtaagtaccttagttaccttaagttacccgtaccgtttccggaaccggtaaccggttacgggaacggaaccgggtagaaaggttaacgaaacgtctaaaggaacccttggaccggctaccggtactaaccgtcgtttacgttaccgttccgtttaccgtacccttaccttccccggtaacctgtcctaaaccgg

SEQ ID NO: 169214 - DNA, 676 bp, Homo sapiens
  misc_feature: GYAE6OF01BNM6O.37.11.A11.1.454.CMB.1.raw
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
tcagtagtgtagatcacgaccggtgctcgatttagctacgactgcaggggcagcaagatggtgttgcagaccaaggtcttcatttctctgttgctctggatctctggtgcctacggggacaccgtgatgacccagtctccagactccctggctgtgtctctgggcgagaggcctccatcaactgcaagtccagccagtacttgttttangcagcctaccaacaataagaacttacttagtcttaggtatcagacaagaaaccgnggcacgcctacctaaactcgctactatttacgtggactacgtaccggtacccgggtacggtcccgggtcctacgaccgtagttacgaggtcggacgacggtcggtcgtacggactagtactttcgacttcgcaacctactacaacgacgtcctgacgacggtcgtaggagggtacttggtacggtaccgttattttaacgtacgttgtaccgtagtacttaaagttactttaacttacgtacccgttaccgtacccggtacggttaccggaaccggtaaacgggtaaccgtaaggtaacggtaaactaaccggtaaaacgtacgttcgggtaacgccgtacggaacctaccgttacgttaccgttcgttaccttactacccgttacccgttaacccggtctacgttaacccg

SEQ ID NO: 169215 - DNA, 629 bp, Homo sapiens
  misc_feature: GYAE6OF01BCP7E.37.11.A11.1.454.CMB.1.raw
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaaacaataagaacttacttagcttggtatcagcaagaaaccgagggcacgcctacctaaactgctctatttacgngggcaatccgtaccgggnggtcccggggtccctggaccgtattcaggtcggcgaggtccgggtcgtaggacagtacttcgactccgtcaaccatcgagcacggccctggacagggtcctaggaagtgtggtggtacttaagttttacgttcgtcgttctgtactagtttagttcggtacctccgtcggttacgttcggccgtacgaacgggtaaccgtaagggtcgtagtacgtaccgaaaggtcccgtaaggttcggacggttccgttcggaccctaaccgtacgttaccgttaccgttacccgtttaaccgtaccttccccgttccccggtaacc

SEQ ID NO: 169216 - DNA, 495 bp, Homo sapiens
  misc_feature: GYAE6OF01BIX3E.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttatactgtcagcagtattataatactcctcgacgttcggccaagggccaaggttgaaatcaaacgactgtggctgcaccatctgtcttcatcttcccgcatctag

SEQ ID NO: 169217 - DNA, 490 bp, Homo sapiens
  misc_feature: GYAE6OF01AVL1U.37.11.A11.1.454.CMB.1.raw
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccggagtccggggtccctgaccgattcagtggcagcgggtctgggacagatttcactctcaccatcaacagcctgcaggctgaggatgtggcgatttatactgtcagcagtattataatactcctcgacgttcgcgaagggacaaggtgaatcaaacgacngtgcngcacatctgtnttcactctcccgcatntacg

SEQ ID NO: 169218 - DNA, 664 bp, Homo sapiens
  misc_feature: GYAE6OF01D8CKR.37.11.A11.1.454.CMB.1.raw
  modified_base (294)..(294): a, c, t, g, unknown or other
  misc_feature (294)..(294): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagcctaccaaacaataagaactacttagcttggtatcagacaagaaaccagggcacgcctacctaaactgcctctatttacgngggactacgtaccgtacccggggacggtcccgggtccctagaccgtattcgaggtcggcgaggtcggtcgtaggacagtactttccgactctacacctataccaacgcgtcccgtgaccgaggcgttaggacggtatcgggtcgtacgtaatttacgttactgtacgagtacttaagttaattaacgtaacttaacgtaccgtaccgtaaccggtttaccggaaccggtaaacggggtaaccgtaaagggttaacgaaaacgtctaaaaaccggtacgttgggtaccggtacgtacggtaccctaaccgtacttacgttcgtttaccttacctacttacccccgttaccccgacttacgtacgttaaccg

SEQ ID NO: 169219 - DNA, 606 bp, Homo sapiens
  misc_feature: GYAE6OF01DCH9E.37.11.A11.1.454.CMB.1.raw
  modified_base (599)..(599): a, c, t, g, unknown or other
  misc_feature (599)..(599): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgtttatacagctacaacaataagaactacttagcttggtatcagcaagaaaccagggcacgacctacctaaactcgactctatttacgtgggacactaccgtacccggggtagtcccggggtccctaggaccgtattcgaggtcggcgaggtcgggtcgtggactagactttcactctcaccatacaacagcctgacgaggcgtagaggtaatggtaggacttaagtttaacttactggtacaggtactagttaatttaataacttaccctccgtaccggtaaccgttaccggacccgtaaaaggggtacctaaagggtacggaaaactaccgaaaacggtaactggacgtctagacccaactacttcgtacgttcttacacttaccctcccgacntctaacg

SEQ ID NO: 169220 - DNA, 681 bp, Homo sapiens
  misc_feature: GYAE6OF01DFY5T.37.11.A11.1.454.CMB.1.raw
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactcctggctgtgtctcgtgggcgagagggcctccatcaactgacaagtccagccagtacttgttttanacagctaccaaacaaataagaacttacttagcttaggtatacagacaagaaaccgagggcagccctacctaaactcgctactatttacgnggacactccgtacccgggagtcccgggtcctagaccgattcgaggtcgcgaggcgggtcgtagggacagtactttacactctacaaccataccaaacgtcgtcctggacgaacgggtcgtaggaacggtagttagggttacgggtaacgttaactttttaacgttaccgtacggttacgaagtacgttaaacgtttaaatttaaccttaaacttacccgttacccgttaaccgggtaccgtttacggggaaccccgaaaggggtaacccgtaaaggtacgtaaaactaccggaaaaccgtagttacgggtacgactacggacaaccggtacttcgttcgtctttaccaccgtttccgtacccctcgacttacgtaaacg

SEQ ID NO: 169221 - DNA, 583 bp, Homo sapiens
  misc_feature: GYAE6OF01D0EST.37.11.A11.1.454.CMB.1.raw
  modified_base (374)..(374): a, c, t, g, unknown or other
  misc_feature (374)..(374): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactgctcatttactgggcatcgtacccgggacggtcccggggtccctggaccgtattcaggtggcaggcgggtctggacagtattcactctcaccatcaacngcctgcaggctgaggatggtggacgtatttacttactgtcagtacagttatttaataactactcccgtaccgaacggtttaccggccgtaaacggggacctaaaggggtacgaaacttccaaaacggtacgttaggtcggtctagccctaacctacgttccgttcggtacttccgtaactttccgttaccccgactacttcgttaaacg

SEQ ID NO: 169222 - DNA, 754 bp, Homo sapiens
  misc_feature: GYAE6OF01CTCR2.37.11.A11.1.454.CMB.1.raw
tcagtagtgtagatcacgaccggtgctcgatttagctacgactgcaggggcagcaagatggtgttcgcagacccaggtcttacactttctctgttgctctggtactctctggtgccgtacggggaccaccgtgaatcgaccccgagtactccagtactccctggctgtcgtctcgtgggcgagtagggccctccaagtaccaaactggacctaaacgtccagacccagtaccgttaggttttaacaacgacgaccttaaccaaaactaaataaagtaaccttacttaacgcgttcggtactacgaacgacgaacgaaaccgacgggaccacgtaccctaaccgtaaactcgtacctactacgttaacgtcgggacctacgttacccggtaacccggggtaacggttcccggggtaccctaggacccggtatttaccggacggtcggaccgtacggtcggtacgtacgggacgtaggtacttccgacgtactaccgaacctactaccaacgacgacctacgacgacggtacgtacggaggtaacgtcggtacggtaacgttagtttaactacgtgtacgtagtacttagtaacttactaacgtacctccgtacggttaccgtacggaccgtaaacgggtaccaagggttaacgaaaccgtaccgaaacgtacgtacgtacgtaccgtagtaccgtaacgtacgttcgtacgttactaccgttacgttaccctaccccggctacgttcccgtaacg

SEQ ID NO: 169223 - DNA, 668 bp, Homo sapiens
  misc_feature: GYAE6OF01C89KC.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttatacagctaccaacaataagaactacttagcttggtatcagcaagaaaccgagggcacgccctacctaaactgctactatttacgtgggactagtccgtacccgggacgtcccggggtcctagaccgtattcgaggtcggacgaggcgggtcgtgggactagtacttcactctaccacctactacaaaccgacgtcctcgacgacgggctaggagggtattgggtacgggtacttaattttaagttaccgtggtaccgtaagtaccgttaaagttaactttaaactaacgttacccttacccgttaccgggtaaccggtttacccgggaaccgtaaacggggtacccgtaaaggggtacgtaaaactaccgaaaaacggtcgttacggcggtactacggacctaaccgtattccgtacgttacttaccgtacttcccgttaccccgacctagttccgtaacg

SEQ ID NO: 169224 - DNA, 654 bp, Homo sapiens
  misc_feature: GYAE6OF01DOW6T.37.11.A11.1.454.CMB.1.raw
  modified_base (210)..(210): a, c, t, g, unknown or other
  misc_feature (210)..(210): n is a, c, g, or t
  modified_base (304)..(304): a, c, t, g, unknown or other
  misc_feature (304)..(304): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctccagactccctggctgtgtctctgggcgagacgggcctccatcaactgcaagtccagccagtacttgttttanacagcctaccaaacaataacgaactacttagtcttaggtatcagcaacgaaaccgagggccagaccctacctaaactgccttacacttttacgngggactacgtccggtacccggggacgttcccggggtaccctcggaaccgtacgtttcgaaggtcggaccgtacgggtcgggtacgtgggaactaggtactttccactctaccgaccatacaacgacgtcctgacgaggtactaggacggtagtggtacgggtacgttattttaacttacgtgttaccagtctaaagtttaattaactaacttacccgtccgtacggtaccgttcggaaccgtaacgggacgtaacggtagaaactacgaaacgtacgtgacggctacgaccgtacctagttctacgtttactccgtacttaccccgttacccgaccttcgttccgtaacg

SEQ ID NO: 169225 - DNA, 696 bp, Homo sapiens
  misc_feature: GYAE6OF01ELUE1.37.11.A11.1.454.CMB.1.raw
  modified_base (224)..(224): a, c, t, g, unknown or other
  misc_feature (224)..(224): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaaanactaaactaacttacgtacgttgtagtactacgacgaacgaaaccgaacggacggacgacctacctaacctacgtctactacttacgttacggtcggtactacgtaccggtaccgggtacccgggtaccccggtccgtaccgtacgtacgtacgtacggctaggtcggggtactgggggacctagggaactttccgaactttcctactaccctactaccgaaacctagaccctaggcctagggcctaggacggtagtacggtaggtcgtagtttacgtacttagttactaggtctaagtactaataacttactaccttaccggtaccgttaccggaccctaaggggtacccgaaagggtacggaaaacgtacgaaaacgtacgtacggtaacggtaccgtacggcctaccgtacgtcccttacgtacctttcgtaccgtttaccttaccccgtcccttaaccgtccgtaacg

SEQ ID NO: 169226 - DNA, 529 bp, Homo sapiens
  misc_feature: GYAE6OF01BVGQK.37.11.A11.1.454.CMB.1.raw
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
  modified_base (373)..(373): a, c, t, g, unknown or other
  misc_feature (373)..(373): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctcaacaataagaactactagcttggtatcagcagaaaccagggcagcctcctaaactgctcatttacngggcatccgtacccgggagtcccggggtccctggaccgattcaggtcggcaggtcgggtctgggactagtactttcactctcaccatcaacngcctgcagctagagatggtgcgtatttatactgtcagctagttatataactctcctcgtacgttcggaccaagggacctaaggtcgaaatacgaaacgacgtgtcgactgacctacattcgtcgttcttacgtacttcccttacccactgtctacg

SEQ ID NO: 169227 - DNA, 600 bp, Homo sapiens
  misc_feature: GYAE6OF01DA5GM.37.11.A11.1.454.CMB.1.raw
  modified_base (208)..(208): a, c, t, g, unknown or other
  misc_feature (208)..(208): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctgggcgagagggcctccatcaactgcaagtccagccagactgtttanacagctacaacaataagaactacttagcttggtatcagacaagaaaccgagggcacgcctacctaaactgactcatttactggcagtccgtacccgggacgtcccgggtcctcgaccgtattcgaggtggcaggcggtctaggacagtattcactcncacatcaacngcctgcgaggctaggagagtggtgacgttaatttagtactgtacagactaagtaatttaataacttaccttcccgtaccggtacggttaccggacccgaaaggggaacccgtaaagggtacggtaaacgtaccgaaaacggacgttacggtacggtaccgtacgacctaaccgtattccgttagttacctttacaccttcccgtacccgcctacgtccgttaacg

SEQ ID NO: 169228 - DNA, 793 bp, Homo sapiens
  misc_feature: GYAE6OF01AW6A8.37.11.A11.1.454.CMB.1.raw
  modified_base (258)..(258): a, c, t, g, unknown or other
  misc_feature (258)..(258): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagtcttggtatcagcagaaaccngggcagacctacctaaactgctcatttactgggcactccgtaccgggcggtcccgggtcctcgaccgtatcgaggtcggacgacggtcgggtcgtagggaccagttacttaccacgttccctaccaacctactacccaacgtacgtacccgtacggccgtacggtcgtacggaagggtacgttggggttacgggtaacggttaagtttttaacgtttacggttaccgttacgaacggtacgttaaacggtttaacttttaaacgttaaacctttacccgttaaccccgttacccgggtttaccgggtttaaccccggggtaaccccgggtaaaccgggggttaaaccggttaaaacggggttaaacgggtaaaacccgttaacccgggtaaaaaccggtaaaccggttcgggttaaccgggacgttaacccggtaccccgttaacccgtacgtttacccgttacgtttaccccgtttaccgtacccgttttaccccccggtaccccttaaccccttgtttaacccgttaaacccg

SEQ ID NO: 169229 - DNA, 643 bp, Homo sapiens
  misc_feature: GYAE6OF01BWD9O.37.11.A11.1.454.CMB.1.raw
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttatacagctaccaaacaataacgaactacttagtcttggtatcagacaacgaaaccgaggacacgccctacctaaactgctactatttacgngggctacgtccggtacccggggtacggtcccggggtcctacgaccgtattcgaggtcggacgacggtccgggtcgtacggactaggtactttaccgactctaccacctactaccaacgtacgcctcgacgacgggcgtaggaggtagtggtggtacgttaattttacgttacgtcgtactacgtactaagttattacttcgttacctcctacgtacgttcggtttacggacggtacgggaacctagggtcgtagggagtacgtcggaccgtaacggtacgttcggtacggccgtacgaccctacctagttccttcgttactttaccgtccgttccccgttcccg

SEQ ID NO: 169230 - DNA, 594 bp, Homo sapiens
  misc_feature: GYAE6OF01DMMDN.37.11.A11.1.454.CMB.1.raw
  modified_base (298)..(298): a, c, t, g, unknown or other
  misc_feature (298)..(298): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttatacagcctaccaaacaaataagaactacttagcttggtatcagcaagaaaccaggggccagcctacctaaaactcgctactatttacgngggccatccgtacccgggacggtcccggggtcctgaccgattcgagtggcaggcgggtctgggactagtactttcacttctacacctaatacaactacgcctgcaggctgaggtatggtggtactatttattactgtcagctagttattactaatacctccctaccggtacgtttccggaccaaaggggacctaaagggtacgaaactcgaaaaccgtaacgtgtcgggtctcgaccctaactacgtttacctcgttaccttaccactttccccttaccccgacctatccgttaac

SEQ ID NO: 169231 - DNA, 778 bp, Homo sapiens
  misc_feature: GYAE6OF01CNDZ1.37.11.A11.1.454.CMB.1.raw
  modified_base (207)..(207): a, c, t, g, unknown or other
  misc_feature (207)..(207): n is a, c, g, or t
  modified_base (297)..(297): a, c, t, g, unknown or other
  misc_feature (297)..(297): n is a, c, g, or t
tcagtagtgtagatcacgaccggtgctcgatttagctacgactgcaggggcagcaagatggttttgcagacccaggtcttcatttctctgttgctctggatctctggtgcctacggggacaccgtgatgacccagtctccagactccctggctgtgtctctgggcgagaggcctcatcaactgcaagtccagccagacttgttttanacagctaccaaacaataagaacttacttagtcttggtatcagacaagaaaccgagggtcacgcctacctaaactgacttactatttacgnggcactccgtacccgggacgtcccggggtcctaggaccgtattcgagtcggcgacggcgggtctgggactagtattcactctaccaacctaataccaaacgtacgcccgttacgacgaacgggtccgtaagggaacgggtattacggggttacgggtaaccggtttaaacttttttaacgttaacggtttacggtaaccgttacgggtacgttaaacggtttaaactttaaacgttaaacctttacccgttcccggttaacccgggttaccgggttttacccgggaaaccggttaaacggggtaaccccggtaaaagggttacgggtaaaaacttaaccggaaacccgggttaaaccgttcgggttaaccggtacgttcgtaaaccccggtaaccttaacttccggtttaaacgttcctttaacccgtacgtttacccccgtttaccccgtacctaaactttcccggtaaacttaaacccg

SEQ ID NO: 169232 - DNA, 695 bp, Homo sapiens
  misc_feature: GYAE6OF01C1AR6.37.11.A11.1.454.CMB.1.raw
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtcctccagactccctggctgtgtctcgtgggcgagagggcctccatcaactgcaagtccagccagacttgtttaanacagcctaccaaacaaataacgaacttacttagcttggtancagcaagaaaccngggacacgtcctacctaaactgactctagtttacgtgggcacgtccgtacccggggtacggtcccggggtccctgaacccgtagtttccgaggttcgggaccgtacgggcggggttccgtacggggtaactagttacttttccaacttccttaccgaaccctaatacccaaacgtcggtccctagaccgtggtccgtagggaggttacgtggtacgggtacgttttaatttaacgttacgtcggttaccaagtcgtaaagttactttaattaaaccgtaccgttacccgttaccgggtaccgttacgggaacccgtaacggggtaacgtaagggtaacgtaaacgtcgtaaaacgtcgtaggtcgcgtaccgtctaccgtacttcgttcgttacttacctaccgttcccgttacccgctacgtcgtaacg

SEQ ID NO: 169233 - DNA, 735 bp, Homo sapiens
  misc_feature: GYAE6OF01CCWUY.37.11.A11.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (279)..(279): a, c, t, g, unknown or other
  misc_feature (279)..(279): n is a, c, g, or t
  modified_base (324)..(324): a, c, t, g, unknown or other
  misc_feature (324)..(324): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccgtggctgtgtctcgtgggcgaggacgggcctcatacaactgacaagtccagccaagtacttgtttaanacagcctaccaaanaaataagaacttactagtcgttaggtactacagacgaacgaaaccgngggacacgtaccctaactaaacgtcgtacctacttaagtttacgngggacctacgttacccggtacccggggtacggttcccgggtaccctacggtaacccgtagttaccgaggtcggaccgtacgggtccgggttacggtacgggtaactacggttacctttacgaccttacctaccaacctaactaaccgaaaccgtacgtccgtacgaccggtaacggtcgtaacgggtagtaacgttgggtacgttaacgtttaagttttacgtacgtcgtaacgtaagtacgtaacgtttaaatttaactaaccgttaccttacccggtaccgtaacgggttacccgaacggaaacggtacgtaagtaacgaaacgtacgtaaacgtcgtgtacgaccgtacgacccgtaattctgttccgttactaccgttcctacccgttaccacgttactcgttaacg

SEQ ID NO: 169234 - DNA, 674 bp, Homo sapiens
  misc_feature: GYAE6OF01AE5QY.37.11.A11.1.454.CMB.1.raw
  modified_base (499)..(499): a, c, t, g, unknown or other
  misc_feature (499)..(499): n is a, c, g, or t
  modified_base (656)..(656): a, c, t, g, unknown or other
  misc_feature (656)..(656): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggagggcctccatcaactgacaacgtccagccagtacttgttttaatacagcctaccaaacaataaacgaacttacttagcttaggtatcagacaacgaaaccgagggcacgtacctacctaaactgctactatttacgcgggcacgtaccgtaccgggtacggttcccgggtccctacggaccgtattcgaggtcggcacgggtcgggtcgtaggacagttacttacactccaccactactaccaacacgccgtgcagggtctaggtacggtagtcgggtggtactttaattttacgtaccttagaccagtacgttaagttaactttaanaacgtttcccgtacccgtaccgggttaccgttaacccggggacgtaaaacggggaccgtaaggtaacggaaacttaaccggaaaaccgttagtggtaaccggtcacggtaccctaacgtcttccgttctttacctaccctacttccccgttaccccncttaacttcgttaaaccc

SEQ ID NO: 169235 - DNA, 697 bp, Homo sapiens
  misc_feature: GYAE6OF01BXTTI.37.11.A11.1.454.CMB.1.raw
  modified_base (348)..(348): a, c, t, g, unknown or other
  misc_feature (348)..(348): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagaggcctccatcaactgcaagtccagccagactgttttatacagctaccaaacaataagaactacttagacttggtatcagcaagaaaccagggacagacctacctaaactgctctatttactgggctatcgtacccgggagtcccgggtccctgaccgattcgagtcggcaggcgggtntgggactagtactttcactctacacctataccaaacacgcctgaccgtagggtcctaggaaggtagttcggtacgggtacgttaatttacgttaacgtggtacctaggtacctaaggttaatttaacgtaaacttacccgtttacccgttaccccgggtacggtttacccgggaccgtaaacggggtaaccccgaaaggggtttaacggaaaacgttaccgaaaaaaccgggtacgttacggtaccgggtaccgttaccggaacccgtaacccgttaaacgttcccgttacgtttccgttacccttaaaccgttcccgtttaaccccccggcctaagttcccgtaaacg

SEQ ID NO: 169236 - DNA, 609 bp, Homo sapiens
  misc_feature: GYAE6OF01CDGA9.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttatacagctacaacaataagaactacttagcttggatcagacaacgaaaccgagggcagcctacctaaactgcctctatttacgtgggcagtccgtacccgggaggtccgggtacctgaccgtattcgagtggacaggcggtctaggacagtacttcactctacacatcaacagcctgactagcaggagatgtagctattatactgactagtctaagttatagtaactacctccctacggtaacccgttcggaccgtaaacggggtaaccgtaacgggtagtaaaacgtaccgaaaaaccggtacgttacggtacgggtacctacggtaccaaccgttacgttcgttacgttacccttacgttaccgtttaccccgttccccgaaccttgtttaccgttaacgg

SEQ ID NO: 169237 - DNA, 699 bp, Homo sapiens
  misc_feature: GYAE6OF01C4H8X.37.11.A11.1.454.CMB.1.raw
  modified_base (216)..(216): a, c, t, g, unknown or other
  misc_feature (216)..(216): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggacgggcctccatcaactgcaagtccagccagtacttgttttaanacagcctaccaaacaaataaagtaacttacttagtcttaggtatcaagacaaacggaaaccgagggaccacgtaccctacctaaactcgtactactagtttacgtgggactacgtcccggtacccggggtacggtcccggggtccctacgaccgtattcggaggtcggcgaggtcgggtcgtcgggactagttacttcactctaccactactacaacgtacgcctaggacgacggtcgtaggaggtagtggtacggtacgtttatttacgtacgtgtctagtactagttaactttaacgtaactttcccgtacccgttaccggtaaccggtttacccgggaaccggaacggggtaacccgtaaaggggtaacggttaaaccgtaacgaaaaccggttaacgttcgggtacgtacgtacggaccctaacgttacttcgttacgttaccttcctacctttcccttacccgacctagttcctaacg

SEQ ID NO: 169238 - DNA, 643 bp, Homo sapiens
  misc_feature: GYAE6OF01D0ND1.37.11.A11.1.454.CMB.1.raw
  modified_base (210)..(210): a, c, t, g, unknown or other
  misc_feature (210)..(210): n is a, c, g, or t
  modified_base (292)..(292): a, c, t, g, unknown or other
  misc_feature (292)..(292): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtactgttttanacagctaccaacaataagaactacttagcttggtatcagacagaaaccagggcacgcctacctaaactgactactatttacngggactacgtccgtacccggggtacggtcccggggtcctacggaccgtatttcgaggttcggcgtaggcgggtcgtagggactaggtactttcactcctaccaaccataccaacacgcctgacacgggtctagagggacttggtacggtactaagttttactacgtggtacagtctaagtttattaactaacttccgttacccgtacccggtacggtttacccggacccgaaagggggtaaccgtaaacggttaacggtaaactaccgaaaacggtaacgtgtacggtactacgactaccagttccgtagttcctacgtacttccccgttcccgtacctagttccgtaacg

SEQ ID NO: 169239 - DNA, 664 bp, Homo sapiens
  misc_feature: GYAE6OF01DOOP3.37.11.A11.1.454.CMB.1.raw
  modified_base (222)..(222): a, c, t, g, unknown or other
  misc_feature (222)..(222): n is a, c, g, or t
  modified_base (313)..(313): a, c, t, g, unknown or other
  misc_feature (313)..(313): n is a, c, g, or t
  modified_base (420)..(420): a, c, t, g, unknown or other
  misc_feature (420)..(420): n is a, c, g, or t
  modified_base (654)..(654): a, c, t, g, unknown or other
  misc_feature (654)..(654): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctccagacctccctggctggtgtctcgtggggcgaggacgggccctccatcaactgacaacgtccagccagtacttgttttanacagcctaccaaacaaataagaacttactagcttaggatcagacaacgaaaccgaggcacgtcctacctaaactcgactactactttacgnggtcacgtccgtaccgggacggtcccgggtccacgaccgattcgacgtcggcgaggcgggtcgtacgggactagtacttcgaccttctaccgacctatacccaaacncgtccgtcgacggtacggcgtagggtacgtacgtgggtacgtacgttaattttacgttaccgtacggtacgacggttactaaggtttaacttacttaacgtaccttcccggtaccgtacggttaccggaccggtaaacggacgtaaacggtaaggaaacctacgaaacgtacgtgtacggtactcgacctacctattcgttaccgtacctttacgtacccttcctacccctacnggttcctacg

SEQ ID NO: 169240 - DNA, 621 bp, Homo sapiens
  misc_feature: GYAE6OF01B29SS.37.11.A11.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
  modified_base (408)..(408): a, c, t, g, unknown or other
  misc_feature (408)..(408): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagaggcctccatcaactgcaagtccagccagtacttgttttanacagcctaccaaacaaataagaactacttagcttggtatcagacaagaaaccgagggcacgccctactaaactgctactatttacgnggactacgtccgtacccggggacggttcccggggtccctcggaccgtattcgaggtcggacgagggtcgggtcgtagggactagtactttccactctaccaccatacaacngtcctgacgacggtctaggaggtattggtaggtacgttaatttactacgtgtacagtactaagttattagttcgttaccttcctacgtaacgtttaggtttcggaccgtaacgggtaccaaggtcgtaggaagtacttacgaccgaacgtacgtggtaggccttgacctaacctgttccttacgtttcttacctaccgtttccccgtaacccg

SEQ ID NO: 169241 - DNA, 574 bp, Homo sapiens
  misc_feature: GYAE6OF01E1CJC.37.11.A11.1.454.CMB.1.raw
  modified_base (285)..(285): a, c, t, g, unknown or other
  misc_feature (285)..(285): n is a, c, g, or t
  modified_base (376)..(376): a, c, t, g, unknown or other
  misc_feature (376)..(376): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactactagcttggtatcagcaagaaaccagggcagcctacctaaactgctctatttacngggcatccgtacccgggagtcccggggtccctggaccgtattcgagtggcgaggcgggtctgggacagtatttcactctcacataccaacncgctagcaggctaggaggatggtgtacgtaatttatgctgtctagactagttaattactaatacctcgtccgtacgttccggaaccgaagggaaccgtaagggtacgaaataccgaaaacggtaccttaggtacggtcgtcgaccaaccgtagttcctacgttcctttaccactttacccttccccgctacgttaccg

SEQ ID NO: 169242 - DNA, 641 bp, Homo sapiens
  misc_feature: GYAE6OF01AZICW.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcaagaaaccaggcagcctacctaaactgctactatttactgggcacgtcgtacccgggacgtcccggggtaccctggaccgtagttcgagtcggccaggtcggtctgggacagtacttcactctccacactacaacgacgcctgacgacggtcgtagaggattggtcggtacgttactttaacgttacctgtaccgtagaccgtaagtttaacttaacgtaacttaccgtcccgttacccggtacgttaccgggaccgtaaacggggtaacctaagggttaacgaaactaccggtaaaacgtaaccgttgtacggaacccgtaggaccctaacccgatttaccgttcgtacctttacgtaccgttacccgttaccccaccgttagttcccgtaacg

SEQ ID NO: 169243 - DNA, 586 bp, Homo sapiens
  misc_feature: GYAE6OF01C4ZJQ.37.11.A11.1.454.CMB.1.raw
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtactgtttttanacagcctaccaaacaataagaactacttagcttggtatcagcaagaaaccagggcagcctacctaaactgctcatttacgngggcatccgtaccgggagtcccgggtcctgaccgattcagtcggctaggcggtctgggactagtacttcactctcacctatcaacngcctncgnggctgaggatggnggtacgttatttagtactgtacagactatattaacttaactcctacctacgtacgtttacggaccgaaagggtaccgtaagggtaacggaaattaccgaaaacgtaacgttaggtacggacgtacgaccaacgtacttcttacgttcctttacgtaccttacccttcccggacccttgttccgtaacg

SEQ ID NO: 169244 - DNA, 794 bp, Homo sapiens
  misc_feature: GYAE6OF01EO1VV.37.11.A11.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttanacagctaccaaacaataagaacttacttagcttggtatcagacaacgaaaccgagggacacgcctactaactcgactctatttacgngggactacgtaccggtacccggggtacggttcccggggtccctacggaccgtattcgaggtcggacgacgggtccgggtcgtacgggactagtacttccgacctcgtaccacctataaccaacgtacgtccgtcgacggtagggtccgtagggtacggtagttcgggtacgggtacgtttaacttttaacgtttacgtacggtactaacgggttacttaaaggttttaactttaaacgttaaaccgtttaccccgttaccccggtttacccgggttaaccgggtttaccccgggggtaaacccgggtaaaaccggggggtaaccgttaaaagggggttaaaccgtaaaaaccgttaaccccggtaaaaacgggttaaccggttaggggttaccggtaccgtaccggtaccctaacccgttacgtttccggttacgtttaccccgtttaacttacccgtttaccccgttacccccgtaccgttacttccggttaaacg

SEQ ID NO: 169245 - DNA, 629 bp, Homo sapiens
  misc_feature: GYAE6OF01CL9PG.37.11.A11.1.454.CMB.1.raw
  modified_base (208)..(208): a, c, t, g, unknown or other
  misc_feature (208)..(208): n is a, c, g, or t
  modified_base (380)..(380): a, c, t, g, unknown or other
  misc_feature (380)..(380): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagacaagaaaccgagggcagccctacctaaactgctctatttctgggctatccgtacccgggtagtcccgggtccctgaccgtattcgagtggcaggtcggtctggacagtacttcactctaccacatccaaacncgcctgacgaggtcgtaggacggatggtacggtacgtattttaacgttacgtgttacgagtactagttaatttaattaactacccgttaccgtacccggtacggtttaccggaccgtaaacgggaccgtaaagggttacgaaacgttacgaaaaccggtacgttaggtacggtaccgttcggacctaacctagttccgttacgttccgttacctactttacccctaccccggtacctacgttcctaacg

SEQ ID NO: 169246 - DNA, 520 bp, Homo sapiens
  misc_feature: GYAE6OF01DGDR0.37.11.A11.1.454.CMB.1.raw
  modified_base (210)..(210): a, c, t, g, unknown or other
  misc_feature (210)..(210): n is a, c, g, or t
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (508)..(508): a, c, t, g, unknown or other
  misc_feature (508)..(508): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtactgttttanacagctaccaacaataagaactacttagcttggtatcagtagaaaccnggcagcctactaactgctactattacgngggcacgtcgtacccgggagtcccgggtccctgaccgattcgagtcggcaggcggtctagggacagtatttcactctacaccatacacagctgcaggctgagatgtgactatttatactgtcagtctagtatatatactccgtacgacgttcgacgaacgggacaaggtagaaactacgaacgtatggtagctgacactatctgtcttacacttcctacccnctatcgtgtaac

SEQ ID NO: 169247 - DNA, 627 bp, Homo sapiens
  misc_feature: GYAE6OF01AYDIC.37.11.A11.1.454.CMB.1.raw
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggcctccatcaactgcaagtccagccagacttgttttanacagctaccaaacaataagaacttacttagcttggtatcagacaagaaaccngggcagcctacctaaactgctactatttacgngggactacgtccgtacccggggaggtcccggggtcctgaccgtnttcgaggtggcaggcggtcgagggangtacttcactcacacataccacncgcctgacgacggcgtaggacggtagtcgggtaggtacgttaagttttactacgtagtaccagtaactagtttactaattactacctccgtacgtaccggttcgaaccgtaagggacctaagggtacgaaacttaccgaaacgtacgtggtacgtacgtcggaccctaacgtacgttcccgttagttacccttacccgtaccgtttacccgtaccccgtaaccttagttcccgtaaacg

SEQ ID NO: 169248 - DNA, 548 bp, Homo sapiens
  misc_feature: GYAE6OF01EGQAA.37.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (540)..(540): a, c, t, g, unknown or other
  misc_feature (540)..(540): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaaacaataagaactacttagcttggtatcagcaagaaaccagggcagcctactaaactgctcattttacngggacacttccgtaccccggggtagtcccgggggtccctggacccgtatttccgaggtggtcaggtcgggtctgggacagtatttcactcctacaccatcaacagcctgacaggctaggaggatgtggacgtaatttattactgtacagctagtattaataactacctcctacgtacgttcggaccaagggaccaaggtagaaatacgaaacgtactagtcgctacgcaccatctagtctactctccttacccnctatcgta

SEQ ID NO: 169249 - DNA, 659 bp, Homo sapiens
  misc_feature: GYAE6OF01DEO8W.37.11.A11.1.454.CMB.1.raw
  modified_base (418)..(418): a, c, t, g, unknown or other
  misc_feature (418)..(418): n is a, c, g, or t
tcagtagtgtagatcacgaccggtgctcgatttagctacgactgcaggggcagcaagatggtgttgcagacccaggtcttcatttctctgttgctctggatcactggtgcctacggggacatcgtgatgacccagtctccagacctccctggctgtgtctctgggcgagagggccacatcaactgcaagtccagccagacttctttgttcagcgtcgaacaataagaacttactttgctttacggaccaaacagaaagcaaggacagtcctctaagttgcttacatttacctcggcacgtcccgacccgggcacgtcccggggtccctcggaccgtattcgacgcggcacggcggggtctggggacaggtactttcactctacaccatcgaacgcgacgcctgacacggcgtagaagntcggtaggtacttagttttactttcgtcgttcgtgtacgttagtttacgtttcgggtacctttccggtccggttacgtttccgggaccggtacggaaccggggtaaccgtaaggggtcggtaacgttaacgtaccgaaaccggtacggtaaccggttgggtacgggtacgtacggacccgttaaccctacggtttccgttacgtttcccgtttacctaccgtttcccccgttaacccccgg

SEQ ID NO: 169250 - DNA, 549 bp, Homo sapiens
  misc_feature: GYAE6OF01AEABA.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatcgtacccgggagtcccggggtccctgaccgattcagtggcagcggtctggacagtattcactctcacatcaacagcctgcaggctggaggatggtggacgtatttatactgtactagtctagttattataactacctccgtaccgtacgttccggacccgtaaaggggaccctaaagggtagaaactacgaaaacgtactggtacggactcgacctacctatccttgtccttactacttcctaccccgctagtcgtaacg

SEQ ID NO: 169251 - DNA, 716 bp, Homo sapiens
  misc_feature: GYAE6OF01A09M8.37.11.A11.1.454.CMB.1.raw
  modified_base (704)..(704): a, c, t, g, unknown or other
  misc_feature (704)..(704): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctcatcaactgcaagtccagccagactgttttatacagctaccaaacaataagaactacttagcttggtatcagcagaaaccgaggcacgcctacctaaactgctactactttacgtgggacctacgtccgtaccccggggtacggttccccgggggtccctcggtaacccgtacgtttcgaacggttcggacgtacgggtccgggtacgtgggaaccgtagtacgtttccaccgttcctacacctactaccaaactaccgccgtcgaccgaacgggtccttagggaacggtagttacggtagggtaccgtttaaagttttaacgtttacgttacggtaccgtaagtacctaagtttaacttaagtaaaccttccgttacccgttaccgggtacgtttaacccgggaccgtaaaggggtaacccgtaagggttaccgtaaaagtacgaaaaccggttcgtaggtcgtactacggacctaacctagttccttacgttaccgttacctaccgttccccgttacccacccgttntacccgttaacg

SEQ ID NO: 169252 - DNA, 761 bp, Homo sapiens
  misc_feature: GYAE6OF01EYLU0.37.11.A11.1.454.CMB.1.raw
  modified_base (292)..(292): a, c, t, g, unknown or other
  misc_feature (292)..(292): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataagaacttacttagcttggtatcagacaagaaaccagggcacgcctacctaaactgctcatttacgngggcagttccgtaccccggggacggttcccggggtccctacggaccgtattcgaggtcggcgacggccgggtcgtagggactaggtactttccgactcgtaccacctactaccaaacgacggccctggacgagggtccgtagggtacgggtaagttcgggttacgggacgtttaaacttttacgttaaccgttacgtaccgtaagtacgttaaacggtttaatttaacttaaaccgtttaacccgttccccgttaacccgggttaaccggtttacccggggaacccgtaaacgggggtaacccttaaagggggttaaacgtaaaccgttaacccggaaaaaccggtaacgttaggttaccgggaccttaacggacccgtaacttacgtttacccggttacgtttaccccttaccgtaaacccggttttcccctttaacccccgtaccttaacgttcccgttaaaaccgg

SEQ ID NO: 169253 - DNA, 827 bp, Homo sapiens
  misc_feature: GYAE6OF01DZ9FO.37.11.A11.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttanacagctaccaaacaataacgaacttacttagcttggtatcagacaagaaaccgagggacacgacctacctaaactgactctatttacgnggctacgtccggtaccccggggtacggttcccggggtccctacggaaccgtagttccgaggtcggacgacgggtccggggtcgtacgggaactaggtactttccgaaccttccgtaccaacctaagtacccaaacgtcgtcccgtaggaccgaagggtccgtagggacggtacgttcgggttacgggtaacgtttaatttttaacgttaaccgtggttaccctaaggtacttaaggtttaaactttaaacgttaaaccgtttacccgttaccccggttaacccgggttaacccggggttttaacccgggaaaccccggtaaaacgggggtaaaccccgttaaaacgggggttaaacgggtaaaaaccgttaacccgggtaaaaaccggtaaaccggtttcgggtaaccgggtacccgttaacggtaacccctaacccggttaactttcccggtttacgttaccccgttttaaccgtaacccttttaccccggttacccccgtaacccgttagtttaccccgttaaacg

SEQ ID NO: 169254 - DNA, 611 bp, Homo sapiens
  misc_feature: GYAE6OF01ENGV8.37.11.A11.1.454.CMB.1.raw
  modified_base (599)..(599): a, c, t, g, unknown or other
  misc_feature (599)..(599): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagacaagaaaccagggcacgcctacctaaactgctctatttacgtgggcactccgtacccggggacgtcccggggtcctggaccgattcgagtggcgaggtccgggtcgtggactagtactttcactctacaccataccaacacgcctgacgaggctgaggtatggtggtacgtatttattacgtgtacgagtactagttaatttactaacttacccttaccgtacccggttaaccggtttacccgggaaccgtaaacggggtaaccgtaagggttacggaaactaccgaaaacgtacgtggtacggctacggacctacctattcctacgttccttactacttcccgttacccnctacgtctaacg

SEQ ID NO: 169255 - DNA, 867 bp, Homo sapiens
  misc_feature: GYAE6OF01A9WWY.37.11.A11.1.454.CMB.1.raw
tcagtagtgtagatcacgaccggtgctcgatttagctacgactgcaggggcagcaagatggtgttgcacgacccaggtcttctatttctcttgttgctctggatctcgtggtcgccgtacgggacaccgtgatcgacccagtcctccagacctcccgtggctgtgtctcgtgggcgaggacgggccctccatacaactgacaacgtccacgccaagtactttagttttaacacgacgtcctaaccaaaactaaataaacgtaaaccttaacttagtcgtttaggtactacgagacaaacgaaaccgagggaccacgtccctaacctaaactcgcctactaatttacggcgggactacgttacccggtaacccggggtacggttccccggggtccctacggaacccgttactttaccggagggtcggaccgtacggggtcccggggttacgtacggggaactacggttaacttttccaaccgttccctaacctaaccctaactaacccgaaaacgtaccggtcccgttacggaccgtaacggggtccgtaaggggtaacggtagttggggttacgggtaaccgttttaaatttttaacgttaacgttcggttaaccgaacggttaccgttaaagttttaaactttaacttaaacctttaccccgttaccccggttaacccgggttaaccgggtttacccgggaaccgggtaaaaccggggtaaccgttaaaggggttaaacggtaaacctaacccggtaaaaaccggtacggttcgggtacgtaccgtaccggaccctaaccgtacgttcgttacgttacccttacccgtaaccttccccggttaccccacttaccgttcgtaaaccg

SEQ ID NO: 169256 - DNA, 718 bp, Homo sapiens
  misc_feature: GYAE6OF01C799B.37.11.A11.1.454.CMB.1.raw
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
  modified_base (687)..(687): a, c, t, g, unknown or other
  misc_feature (687)..(687): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccgtggctgtgtctcgtgggcgagcggcctcatcaacgtgcaacgtccagccagtacttgtttaanacacgtactaaccaaacaaataacgaaccttacttaagtctttaggtactacaacgaccaaaggaaacccgagggaccacgtccctaccgtaaactcgtcctactattttacgngggtacctacgtccggtacccgggacggtcccgggtacccgtcgaccgtattccgaaggtcggacgcgggtcgggtacgtagggacctaggttacttcctacgttacctacaacctactaaccgaaccgtaacggtccctaggacgacggtcggtaaggtacgggtagttgggtacggtacgtttaactttagttaaccgtcgttacgtacggttaacttaggttaaactttaaccgttaacttaacccgttcccgtacggttaccgttaccggtaacgaaacgggtaccgaaagggtacgtaaacgacgtaaacggtactcggtacgtcacggacctacgtagttccgttacgttacncttacctcccttaccgactattcggttaaac

SEQ ID NO: 169257 - DNA, 605 bp, Homo sapiens
  misc_feature: GYAE6OF01D037T.37.11.A11.1.454.CMB.1.raw
  modified_base (369)..(369): a, c, t, g, unknown or other
  misc_feature (369)..(369): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagcctaccaacaataagaactacttagcttggtatcagcagaaaccaggcagcctctaaactgctcatttactgggacacgtcgtacccgggagtcccggggtccctggaccgtattcaggtgcagcgggtctggacagattcactctcaccatcaacngcctgactaggctagacggtatggtggtcgtatttacgttatcgtactagtcgtaagttaagtttaataaacgttacccttacccgttacccggtaaccggtttcccgggaaccgtaaacgggggtacccgtaaaggtcggtaaaactccgaaaacgtaacgttcggtacggtcgtgacctaccacttccgttacgtcctttacgtacttcccttacccgacctatccgttaaacg

SEQ ID NO: 169258 - DNA, 572 bp, Homo sapiens
  misc_feature: GYAE6OF01B1VHN.37.11.A11.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctacaanaataagaactactagcttggtatcagcagaaaccagggcagcctactaaactgctcatttacgtgggcactccgtacccggggacgtcccggggtccctggacccgtattcgaggtcggacaggcgggtctgggactagtactttccgacttcctacaacctagtaccaacacgccctgcaacggctaggaggtatggtgactatttattactgtacagtcagtattaagtataccgtctaccggtacgttaccggacaagggtaccaaggtagaaacgtacgaaacgacgttagtcggacctgactaccattctacgttcttacgtacttcccttacccgctagtcgtaacg

SEQ ID NO: 169259 - DNA, 797 bp, Homo sapiens
  misc_feature: GYAE6OF01B8KHZ.37.11.A11.1.454.CMB.1.raw
  modified_base (218)..(218): a, c, t, g, unknown or other
  misc_feature (218)..(218): n is a, c, g, or t
tcagtagtgtagatcacgaccggtgctcgatttagctacgactgcagggggcagcaagatggtgttgcagacccaggtcttcatttctctgttgctctggatctctggtgccgtacggggacaccgtgatcgacccagtctccagactcctggctgtgtctcgtgggcgaggacgggcctccatacaactgacaagtccagccagtacttgttttaanacagtcctaccaaacaaataacgaacttacttagtcttaggtatcgagacaacgaaaccgagggacacgtcctaacctaaacgtcgtactactaactttacgtcgggctacgttcccggtaacccggggtacgggttccccggggtaccctaggtaccgtagttcgaggtcggacgacgggtcgggtcgtcgggaactaggttacttacactcctaccaacctactaccaaacgacgtccgtacggacgagggtcctagggaacggtagttcggtacggggtactttaagttttaacgtacgttcggtacacggtaaccgttaagtttaaactttaacgtaaactttaccccgttcccggttaccggttaaccgggttacccgggaaacccggtaaacgggggtaaaccccgtaaaggggttaaaccgggtaaaactaacccggaaaaaccggttaaccggttgggtaccggtaaccgttaccgggaaccctaaacccgggttctttaaccggttcgtttaccctttacgtaaacccgtttccccgtttaccccggaccctaagttttaccgtaaaccg

SEQ ID NO: 169260 - DNA, 642 bp, Homo sapiens
  misc_feature: GYAE6OF01AYUD3.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaaacaataagaactacttagcttggtatcagcaagaaaccagggacagcctacctaaactgctcatttacgtggcatcgtacccgggaggtcccggggtcctggacccgtattccaggtggcacggtcgggtcgtggacagtactttcactctccacctataccaaacacgcctgacaggctaggacggtatggtcggacgttaattttacgttacgtggttacaggtactaagttaattaactaaacgttaccgttaccccgttacccggtaacggtttaccggaccccgaaagggggtaaccccaaaggggttacgtaaacctacgaaaaaccgtaacgtggttacggacctacggacctaacctaattcccgttcgttaccttacctacgttcccctttacccccgacttacgttccgtaacg

SEQ ID NO: 169261 - DNA, 601 bp, Homo sapiens
  misc_feature: GYAE6OF01DQJRB.37.11.A11.1.454.CMB.1.raw
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaaataagaactacttagcttggtatcaagcaagaaaccagggcaagccctacctaaaactgctctatttacgngggcatccgtacccgggacggtcccggggtcctggaccgattcgagtggcaggcgggtcgtgggacagtattcactcncaccatacaaacngcctgcgaggtctagacggatggtcggngttaattttacttactgtacagtactaagttaattaataacttaccttccctaccggtacgttaccggaccgtaaacggggacctaaagggtaacgaaacgttacgaaacgtaacgtcgtcggtactggacctacctagtccttcgttaccttcgtaccttcccttacccgtccttagtcgtaaacc

SEQ ID NO: 169262 - DNA, 745 bp, Homo sapiens
  misc_feature: GYAE6OF01D3X5U.37.11.A11.1.454.CMB.1.raw
  modified_base (460)..(460): a, c, t, g, unknown or other
  misc_feature (460)..(460): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactcctggctgtgtctcgtgggcgagacgggcctccatcaactgcaagtccagccagacttgtttatacagctaccaaacaataacgaacttacttagtcttaggtatcacgacaaggaaaccgagggacacgcctacctaaactcgactactagtttactgggactacgttaccgtaacccggggacggttccccggggtaccctacggaccgtatttcgaggtcggcgtacggtcgggttcgagggtactaggtactttcaccgtctaccaccaataccaaacacgcccgtagaccgtaagggtcgtaggtaaggngttacggtagggtacggtttaaattttaacgttaccggttacgtacgtaacgtacgttaacgtttaaactttaaacgttacttaacccgtacccgttacccggtaaccgggtttaacccgggaaccggttaaaccggggtaaaccgtaaacggggttaaacggtaaaaccgtaaccggaaaaccggtacgttacggacggtaccgttaacgccctaacgtacgttccgttacgttacctttacccgtcttaccccgttacccccgacttaccgtgttaaacccgg

SEQ ID NO: 169263 - DNA, 567 bp, Homo sapiens
  misc_feature: GYAE6OF01DYMVW.37.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (372)..(372): a, c, t, g, unknown or other
  misc_feature (372)..(372): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttacngggcatccgtacccgggagtcccggggtccctgaccgattcgagtggcaggcgggtctgggacagtactttcactctacacatcaaacngcctgcaggctggagatgtggctatttatactgtcagctagtattataactactccgtcgacgttcggaccgtaaaggggacctaaagggtacgaaactcgaaaacggtaacttggtacggctacggacctaacctagttccttacggttccttaccgtaccttacccgttccccgacccttagttccgtaaacg

SEQ ID NO: 169264 - DNA, 786 bp, Homo sapiens
  misc_feature: GYAE6OF01CCA3O.37.11.A11.1.454.CMB.1.raw
  modified_base (214)..(214): a, c, t, g, unknown or other
  misc_feature (214)..(214): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggacgggcctccatcaactgcaagtccagccagtacttgttttanacagcctacaacaataagaacttacttagcttaggtatcgagacaagaaaccgaggcacgcctacctaactgctactatttacgcggactacgtaccgtaccgggacgttcccggggtcctacgaccgtagttcgaggtcggacgacggcgggttcgtacgggacaggttactttacctaaccgtcctaccaaacctacgttaaacccaaacgtccggtaccgtacggtacccggaacgggtccgttaaggacggggtaacgttggggtttaacgggtaacgtttaaagttttttacgtaacgttcggtaaccgtaagtaccggttaaatttaaccgtttttaaacgtaaaccgttacccgttaccccggtaacgggtttaccccggtaacccgggtaacggtaaaccggggttaacccgggaaaagggtttaacggtaaaacccacgggtaaaaacccgacgggtttacgaccgggtaccttaggaacccttaccgtacgttcccggttagtttacccttaccgttaccgttaccccccgtttacccgaaccttcgttaacgttaacccgg

SEQ ID NO: 169265 - DNA, 597 bp, Homo sapiens
  misc_feature: GYAE6OF01DG3MI.37.11.A11.1.454.CMB.1.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
  modified_base (535)..(535): a, c, t, g, unknown or other
  misc_feature (535)..(535): n is a, c, g, or t
  modified_base (550)..(550): a, c, t, g, unknown or other
  misc_feature (550)..(550): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttanacagcctaccaaacaataagaactacttagcttggtatcagcaagaaaaccgagggccacgacctacctaaaactgactactatttacgngggacagtccgtacccggggacgtcccgggtccctgaccgtattcgagtgcgagcgggtctgggactagtactttcactctcaaccatcgaacngcctgacgacggcgtagaggtaagtggaggtacgtaatttaacttaacgtgtaccagtactaagttattaataactacctcccgtcgtaacgttcggaaccgaaaggggaccaagggacgaaactcgaaaacgtactgggngcgtagacctaaccnttccgtgttacttaccgtacttaccccgttcccgactgttcctaacg

SEQ ID NO: 169266 - DNA, 634 bp, Homo sapiens
  misc_feature: GYAE6OF01DIQ01.37.11.A11.1.454.CMB.1.raw
  modified_base (211)..(211): a, c, t, g, unknown or other
  misc_feature (211)..(211): n is a, c, g, or t
  modified_base (428)..(428): a, c, t, g, unknown or other
  misc_feature (428)..(428): n is a, c, g, or t
  modified_base (594)..(594): a, c, t, g, unknown or other
  misc_feature (594)..(594): n is a, c, g, or t
  modified_base (627)..(627): a, c, t, g, unknown or other
  misc_feature (627)..(627): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagaggcctccatcaactgcaagtccagccagtacttgttttanacagcctaccaaacaaataacgaacttacttagctttggtatacagcaaagaaaccgagggaccacgacccttacctaaaactcgtactactatttacgtgggacctacgtcccggtaaccccggggacggttccccgggggtccctacggacccgtatttccgaggtcggacgacggtcgggtcgtgggactagtacttcactctacacatcaacncgcctgacaggtctaggaggtagtggtagggtacgttatttacttacgtgtacaagtactaagttaattaagtaactaccgttccgtaccggaaccggtttcggaaccgaaggggtaaccaagggtaacgaaactacgaaacgtacgtgtacgctacgaccaactnttctacgttcttacctacttccttccccgactntccgtaa

SEQ ID NO: 169267 - DNA, 793 bp, Homo sapiens
  misc_feature: GYAE6OF01B1BX9.37.11.A11.1.454.CMB.1.raw
  modified_base (176)..(176): a, c, t, g, unknown or other
  misc_feature (176)..(176): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctccagacctcccgtggctgtgtctcgtgggcgaggnggccctcatcaactgacaacgtccagccagtacttgttttaanacacncctaaccaaacaaataacgaacttactagtcttaggtatacgagacaacgaaaccgnggacacgtccctaacgtaaactcgtcctactaacgtttacgcgggactacgttacccggtacccggggtacggttcccgggtacctacgaccgtagttccggaggttcgggaccgagggtccgggtacgtaacgggtactaacggttacttacccgtaacctccgtaacccgtaaccaaccggttaccaaaaccgtaccggttcccgtacggaccggtaacgggtccgtagggtaaaccgggttcggttagggttacccgggttaagtttaacgtttaacgttaacccggtgtaaccgtaggttaacttaaaggttaactttaaccgtaacgtaacccggttacccgtacgggtaaccggtttaccgggaacccggtaaacgggtaaccggtaaaggtaacgtaaacgtaccgtaaaaccggtgtacggtacgcgtaccgtaccgtagtaacttcgtaccgttaaccttcggtaacccctttcccggtaaccctccttaagtcccttaaacg

SEQ ID NO: 169268 - DNA, 777 bp, Homo sapiens
  misc_feature: GYAE6OF01EQFAN.37.11.A11.1.454.CMB.1.raw
  modified_base (766)..(766): a, c, t, g, unknown or other
  misc_feature (766)..(766): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggacgggcctccatacaactgacaacgtccaacgccagtacttgttttaacacacgacctaccaaactaaataaacgaacttacttagtcttaggtactcgagacaaaggaaaccgagggacacgtaccctaacctaaacgtcgtaccttacttaagtttaccggcggggacctaccggttaccccgggtaccccgggggtaccgggttcccccggggtaccctacgggtaacccttacgttacggtaacgggtcggaccggtacgggtccgggtacggtagggaactacggttactttaccacgttcctaccgaactactaaccaacgtacgtccgtaggacgtacgggtacgtagggacggtagtcgggtacggttactttaaagtttacgttacgtcgtactacgtacttaagttaattaacgtaacttacccgtccgttaaccgggtaccgttaccggaaccggtaaaccggggtaacgttaaagggtaacgtaaacctaaccggtaaaacgtcgttcgggtacgtacctacggaacctaccggtacttccggttaccttcttacccgtactttacccccgacgtacccttnaccgttaaccg

SEQ ID NO: 169269 - DNA, 782 bp, Homo sapiens
  misc_feature: GYAE6OF01BYMZI.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagagggccctccatcaactgacaacgtccagccagacttgttttatacagcctaccaaacaataagaactacttagcttggtactcagacaacgaaaccgagggcacgcctacctaaactcgctactaatttacgtgggtacacgttcccggtacccggggtacggttccccgggggtaccctacggtaaccgtactttacgaggtacggccgtacgggtacgggtccggtagggaacctaggttactttccaccgttacctaccgtaacctaactacccaaacgtacggtcccgttagaccggagggtaccgtaggggaacggtagttcgggttacgggtacgtttaaacgtttttacgttaccggttaggttaccgtaggttaactaaaggttttaactttaacgttaacccttacccgtttacccgttacccgggtacgggtttacccgggaaccggtaaacgggtaacccgtaaagggttaacgtaaacgtaaccgaaaaccgtacgttacgggtacgaccgttaccgaccgtaaccgtacgtttccgttacgttaccctttaccgtaccgtttacccccgttacccgaacccttagttcccggtaaacg

SEQ ID NO: 169270 - DNA, 741 bp, Homo sapiens
  misc_feature: GYAE6OF01AW17B.37.11.A11.1.454.CMB.1.raw
  modified_base (690)..(690): a, c, t, g, unknown or other
  misc_feature (690)..(690): n is a, c, g, or t
tcagtagtgtagatcacgaccggtgctcgatttagctacgactgcaggggcagcaagatggtgttgcagaccaggtcttcatttctctgttgctctggatctctggtcgcctacggggacaccgtgatcgaccacgtctccacgactcctggctgtgtctcgtgggcgaggacgggcctccatcaactcgacaacgtcacgccagtacttgtttactacacgtactaccaaacaataagaactacttacgtcttaggtatcacgacaacgaaacgaggcacgtacctacctaaactcgtctactaactttacgtacgggactacgttaccgggaacccggggtacggttccccggggttacctacgtaacccgtagttaccgagggtacggtaccggaacggtccggggttacgtacggggaactaaaggttctttaccacgttcctacaacctactaccaaagtcgtccgtcgacggacgggtacgtagggtacgtagtacgggtcggttaacgttaatttaacgttacgttcggtaacgtacgtacgttaaacgtttaacttaacttaaaccgttcccgttaccgttaccggttaacgggttaccggaaccggtaaacggggtaaaccgtaaagggtaacgtaaacgtaaccgtaaacgtacggtggttacgtactacggttaacctntacgtttgtacccttagttacctacccgtccctactactcgttactaaccg

SEQ ID NO: 169271 - DNA, 525 bp, Homo sapiens
  misc_feature: GYAE6OF01ET1X2.37.11.A11.1.454.CMB.1.raw
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataaagaactacttagcttaggtatcagcaagaaaccaggggacagcctacctaaactgcctctatttacngggcatccgtaccgggagttcccggggtccctgaccgattcgagtggcaggtcggtcnggcagnttcactcncacatcaacngctgcagctgagatggtggntatttatctgtcagcagtattataattctcctcgacgttcggaccgaacgggacaagggtagaactaccgaaagacgtcgtggctagccactatctcgttcttactacttacccttacccgcctatctaacg

SEQ ID NO: 169272 - DNA, 602 bp, Homo sapiens
  misc_feature: GYAE6OF01DY3IR.37.11.A11.1.454.CMB.1.raw
  modified_base (380)..(380): a, c, t, g, unknown or other
  misc_feature (380)..(380): n is a, c, g, or t
  modified_base (571)..(571): a, c, t, g, unknown or other
  misc_feature (571)..(571): n is a, c, g, or t
  modified_base (595)..(595): a, c, t, g, unknown or other
  misc_feature (595)..(595): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcagaggcctcccatcaactgcaagtccacgccacgacttgttttatacacgctaccaacaataagtaactacttagtcttggtatcagcaagaaaccagggcacgtcctcctaaactgtctacagtttacgtgggaccatacgtaccccggggacggtccggggtccctcggtacgtattcgagtggcaggcgggtctggacagtattcactcacnccatcgaacagcctgccaggtctaggaggtatggtacggacgttatttaacgttactcggttacacgtataacgttaatttaacttaatacccttacccgtaccgtaccggtttcggaacccgaaagggggtaccctaaagggtgaaaacgtacaaaaccggtatcggtcggcttggacctaccagtttcncgttcttcacttccttaccccganttacacg

SEQ ID NO: 169273 - DNA, 757 bp, Homo sapiens
  misc_feature: GYAE6OF01DE909.37.11.A11.1.454.CMB.1.raw
tcagtagtgtagatcacgaccggtgctcgatttagctacgactgcaggggcagcaagatggtgttgcagacccaggtcttcatttctctgttgctctggatctcgtggtcgccgtacggggacaccgtgatcgacccagtcctccagacctccgtggctgtgtctcgtgggcgagcggcctcatacaactgacaacgtccagccagtacttagttttaacacgacgacctaaccaaataaataacgtaacttacttagtcttaggtactacgacgaccgaaacggaaaccgagggaccacgtacccttaacctaaagtcgtacctacttaagtttaccggagggtcctaccgtaccggtaacccggggacggttccccggggtcctacgggtaaccgtagttcggacggtcgggaccgtacgggtccgggtacggtaggaactagttacctttacgacgttccgaccaacctataccaacgtacgccgtagccgtaggccgtaggacgtagttggtacgggtatttaacttttacgacgtcggtacaagttactaacgtttaaattaaccgtaacctttacccgtacccggttaaccggtaccggttaacccgggaaccgtaaaacggggtacccgttaaaggtaacgaaaccttaacggtaaactggtcggtaccgacgtaccgaccgtaaccgttcgttacttaccgtttcctaacgttacccgttaccccgtacccgtatacgtaccgttaacg

SEQ ID NO: 169274 - DNA, 519 bp, Homo sapiens
  misc_feature: GYAE6OF01ANI5L.37.11.A11.1.454.CMB.1.raw
  modified_base (362)..(362): a, c, t, g, unknown or other
  misc_feature (362)..(362): n is a, c, g, or t
  modified_base (512)..(512): a, c, t, g, unknown or other
  misc_feature (512)..(512): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatcgtacccgggagtccggggtccctgaccgattcagtggcagcgggtctggacagattcactctcacatcaacngcctgcaggctgagatgtggctatttatactgtcagtcagtattataatactccctcgacgttcggacctaagggacctaagggtgaaactacgaaacgactgtacggctacggccacattcgttgttccttcacttccttcccgacctntctaacg

SEQ ID NO: 169275 - DNA, 831 bp, Homo sapiens
  misc_feature: GYAE6OF01C5FSB.37.11.A11.1.454.CMB.1.raw
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttatacagcctaccaaacaataagaactacttagcttggtatcagacaagaaaccgagggacacgtcctacctaaactgctactatttacgngggactacgttccggtacccggggtacggttccccggggtaccctcggtaccgtagttcgaacggtcggccgtagggtccgggtcgtacgggaactacgtactttccaccttcgtaccaccgaactaccaaactacggtcccgtacggacgacgggtccgttagggaacgggttaacgttgggttcgggtacgtttaacgtttttaacgtttaccgttacggttaccgaaggttaccgttaaaggtttaacttttaaacgttaaacctttacccgttaccccggttacccggttaacccgggtttaacccggggaaacccggtaaaccgggggtaacccggtaaaacggggtttacgggtaaaaccgttaaccggaaaaaccgggtaacccgttcggggtaaccggtaccgttaaccggaaccccgttaaacccgttaacgtttcccgttaccggtttacccctttacccgttaaacccgttttccccccgtttaacccccggtacccgttaacgtttcccgttaaaccggg

SEQ ID NO: 169276 - DNA, 749 bp, Homo sapiens
  misc_feature: GYAE6OF01AZ727.37.11.A11.1.454.CMB.1.raw
  modified_base (214)..(214): a, c, t, g, unknown or other
  misc_feature (214)..(214): n is a, c, g, or t
  modified_base (318)..(318): a, c, t, g, unknown or other
  misc_feature (318)..(318): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggccctccatcaactgcaagtccagccagtacttgttttanacagtcctaccaaacaataacgaaacttacttagtctttaggtactcgaagacaacggaaaaccgagggccaagtccctacctaaactgcctctaactttacgngggacctacgttaccggtacccggggtacggtcccggggtccctaggaccgtattcgaggtcggcgacggtcgggtcgtacgggactaggtactttacgacctcctaccaacctaatacccgaaaaccgtcggcccttacgggaccgtaacgggtccgtagggtaacggtgttcgggttagggtaccggtttaattttaacgttacttaggtacctaaggtaccttaagttaacttaacgttaaacttaccccgttcccgtaacggttacccggttacccgggaacccggtaaacggggtaacccgtaaagggttaacggaaaacttacccggaaaacggtaacgttggtacggtacctacgaccctaccgtacttcgttcgttacccttaccgtaccttccccgttacccgaccttacgttcctaaaccg

SEQ ID NO: 169277 - DNA, 571 bp, Homo sapiens
  misc_feature: GYAE6OF01B0JDK.37.11.A11.1.454.CMB.1.raw
  modified_base (341)..(341): a, c, t, g, unknown or other
  misc_feature (341)..(341): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctaccaacaataagaacttacttagcttggtatcagcaagaaaccagggcagcctacctaaactgctctatttacgtggcatccgtacccgggagtccggggtcctgaccgattcagtggcagcgggtcngggacagtacttcactctacacatcaacagcctgcagtctagaggatggtgcgtatttactactgtacagctagttattaataactactcccgtaccgacggtttaccggaccgaaaggggtaccctaaagggtacgaaactacgaaaacgtaacgtggtacggactacgacctaccaatttccgtagttacctttacgacttcccgttaccccgacctagttcgtaacg

SEQ ID NO: 169278 - DNA, 631 bp, Homo sapiens
  misc_feature: GYAE6OF01CQTKE.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgtttanacagctaccaacaataagaactacttagcttggtatcagcaagaaaccgagggcacgcctacctaaactgcttactatttaccgtgggactacgtccgtacccggggtacggtccccggggtccctaggacccgtattcgaggtcggcgaggtcgggtctgggactagtacttcgactctccaccatccaacacgcctgctaggctggaggtatggtaggacgttaatttacttacgtgttacagtacctaagttacttaataacgtccttacccgtaccggtacgttaccggacccgtaacgggtaccgtaaaggttacgaaacttacgaaaaccggtacgtggtacggctacgaccgtacctattcgttacgttaccttactaccgtttaccccttacccgaccttagttcccgttaacg

SEQ ID NO: 169279 - DNA, 622 bp, Homo sapiens
  misc_feature: GYAE6OF01BUO5A.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtactgttttatacagctaccaacaataagaactacttagcttggtatcagcaagaaaaccgagggcagcctacctaaactgctctatttactgggctactccgtaccccggggagtcccgggggtccctggacccgatttccgaggtggacgtaggcggggttcctggggacaggtactttccactcctccaacctataccaacacgccctggcacgggctgggagtagtggaggtacgtattttaattacgtgtcgtagctaagttattaataacttacctccctacgtaccggttccgaccgaaaggggtaccaagggtaggtaaactaccgaaaacggtaccgtaggtacggacctggtacctaacctacgttacctcgtttaccttctaccctttcttacccccgctacgttcctaaacg

SEQ ID NO: 169280 - DNA, 600 bp, Homo sapiens
  misc_feature: GYAE6OF01A9LOO.37.11.A11.1.454.CMB.1.raw
  modified_base (290)..(290): a, c, t, g, unknown or other
  misc_feature (290)..(290): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataagaactacttagcttggtatcagcaagaaaccagggcagcctacctaaactgctctatttacgngggcagtccgtacccgggacgtcccggggtccctggaccgtattcgaggtcggacaggcgggtcgtggactagtattcactctcaacatcaacagcctgcaggctaggaggtatggtcggtactatttactactgtacagtactagttaattataactacctcccgtacgtacgttaccggaccgaaacgggtacctaagggtacgaaactaccgaaaacgtacgtgtacggtactcgacctaacccgtattccgttacgttacctttaccgtaacctttccccgttaccccgaccttagtccgttaacg

SEQ ID NO: 169281 - DNA, 684 bp, Homo sapiens
  misc_feature: GYAE6OF01A8KB4.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggcctccatcaactgacaacgtccagccagacttgttttatacacgctaccaaacaaataaacgtaactacttagtctttaggtactcagacaagaaaccgagggacacgtccctacctaaactcgactctaatttacgcggactacgtccggtacccggggtacggtcccggggtaccctcggtaaccgtattcgacggtcggaccgagggtccgggtcgtacgggactacgtactttcactcctaccacctataccaacgtacgtcctagaccgacgggtactgggaaggtgtgggtcggaacgtttatttaacttacgtacgtactagtactaagttaacttactaacttaccgttaccgtaccgggttaacgtaccgggaccgtaaaggggtaaccgtaaggtaacgtaaacgtaaccgtaaacggtacgttaggacggtactacgtacctaccgttacttcgttacgttactaccgtacttcccgttacccgcttaactcgttaacg

SEQ ID NO: 169282 - DNA, 685 bp, Homo sapiens
  misc_feature: GYAE6OF01ADKX7.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctcaacaataagaacttacttagcttggtatcagcaagaaaccgaggcagccctacctaaactgctctatttacgtgggcatccgtaccgggacggtcccggggtcctcgaccgtattcgagtggcgaggccgggtcgtgggacagtactttcacttccgtacaccgtactaccaaaccgtacgtcccgtcgacgtacgggtcgttaggagggtaagttcggtcgggttacgtaatttttactaacggttgtacgaaggttacctaaggtttaatttaactttaaaccgttaccgttaccccgttaccggttaccggtttaacccggggaacccgtaaacgggggtacccgtaagggttaacggtaaacgtaacgaaaacggtacgtggttacggctacggaccctaaccgacttccgttacgtttcccttacctacgtttccccttaccccggccttaacgttctaaaccgg

SEQ ID NO: 169283 - DNA, 560 bp, Homo sapiens
  misc_feature: GYAE6OF01EXDPG.37.11.A11.1.454.CMB.1.raw
  modified_base (338)..(338): a, c, t, g, unknown or other
  misc_feature (338)..(338): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactactagcttggtatcagcagaaaccagggcagcctacctaaactgctcatttactgggcatcgtacccgggagtcccggggtccctgaccgattcagtggcagcgggtcngggacagatttcactctcaccatcaacagcctgcaggctgagatgtggctatttatactgtactagctagtatttaataatactccgttaccgacgttcggaccgaagggaacctaagggtacggaaactacaaaacggtaaactcggtacggacttacggaccaacctagtcctttacgtccgtttacaaccttccttccccggacctacgttcgttaacg

SEQ ID NO: 169284 - DNA, 533 bp, Homo sapiens
  misc_feature: GYAE6OF01AMKHN.37.11.A11.1.454.CMB.1.raw
  modified_base (284)..(284): a, c, t, g, unknown or other
  misc_feature (284)..(284): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcataaaccagggcagcctacctaaactgctcatttacngggcatccgtacccgggagtcccggggtccctgaccgattcgagtggcaggcgggtctgggacagtattcactctcaccatcaacncgcctgcaggctggaggntggtggcgttaatttacttacgtgtcagtctagttattaataactcctccctccggtacgttaccggaccgtaagggtaccaagggtacgaaatacaaacgacgtgtcgctgcacatctgtcttctcttcctcccnctntctacg

SEQ ID NO: 169285 - DNA, 615 bp, Homo sapiens
  misc_feature: GYAE6OF01EEP7A.37.11.A11.1.454.CMB.1.raw
  modified_base (209)..(209): a, c, t, g, unknown or other
  misc_feature (209)..(209): n is a, c, g, or t
  modified_base (294)..(294): a, c, t, g, unknown or other
  misc_feature (294)..(294): n is a, c, g, or t
  modified_base (390)..(390): a, c, t, g, unknown or other
  misc_feature (390)..(390): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctccaacaataagaacttacttagctttaggtatcagacaagaaaccagggcacgccctacctaaactgctcattttacgngggcagttccgtacccgggaggtcccggggtcctgaccgtattcaggtcggacaggtcgggtctgggactacgtatttccactctcaccatcaacncgctgacgaggcgtagacggtatcggtaggtacttaagtttaacttcgtgtcagtactaagtttattaataacttacccgtccgttaccggtaggttacccggaacgaacggggaccctaaaggggttaacgaaacgtaacgaaacgtacgtaggtcgtactcggacctacctattcgtcgttaccttacgtacctttccccgtacccgactacttcgtaaaccg

SEQ ID NO: 169286 - DNA, 643 bp, Homo sapiens
  misc_feature: GYAE6OF01ET107.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctgggcgagagggccacgatcaactgcaagtccagccggagttgttttanacaactaccaaagaataagagtttcttagcttaggtaccagcaagaaaccacgacacgcctacctaagctgcttcgtttacgtcgggtcctaccgtacccgggaagtcccggggttccctagaacgtacttacgaggtggccggtcgggtctgggacagtattccactctcaccatcgagcacgcctggcggctagaagtatggtcgtcgtttatcgtgtacagtacgtagttatttagttcgtttacctacccgttacgtacgtttacgggttttaccgggaccgtaagggggtaaccctaaggtaccgtaacgggaacgtacgttcccggaaccgtaacggtaacgttcggtacgggtccttacgaccctaacgtacttcgtacgttccttacctacttcccgttcccaccttactcttagtaacctaccg

SEQ ID NO: 169287 - DNA, 815 bp, Homo sapiens
  misc_feature: GYAE6OF01CTPU7.37.11.A11.1.454.CMB.1.raw
tcagtagtgtagatcacgaccggtgctcgatttagctacgactgcaggggcaggcaagatggtgttgcagacccaggtcgttcatttctctgttgctctcggatctctggtgccgtacggggacaccgtgatcgacccagtctccagactccctggctgtgtctctgggcgagacgggcctccatcaactgacaacgtccaggccagtactttagtttatacagcctaccaaactaaataaacgtaacttaacgttacggtacttaggtactacaacgaccaaacggaaaccgacgggaccacgtacccttaacctaaactcgtccttactacgtttacggtcgggctacgtcccggtacccggggacggttcccggggtccctacggaccgtagttcgaggtcggacgacgggtccgggtcgtagggtaacctaacggttactttaccgaactttccgtaaccaaccttaactacccgaaacgtacggtaccctaggaccgacgggtacgttaagggacggttaacgtcgggttaacgggtaccgtttaattttaacgttaaccggtgttaccgtaacgtacgttaaagtttaactttaaaccttaaccgtttacccttacccgggttaaccggtaccggttaccgggaaacccggtaaacggggtaaccgtaaagggtaacgtaaacctacggtaaaacggtaccgtcggggtacgtaccggttaacgaacccgtaaccgttcgtttaaccgttccggtttaacttacccgtaaccgtttcccgttaccccgaccttacgttacggtaacccg

SEQ ID NO: 169288 - DNA, 745 bp, Homo sapiens
  misc_feature: GYAE6OF01CV1VN.37.11.A11.1.454.CMB.1.raw
  modified_base (234)..(234): a, c, t, g, unknown or other
  misc_feature (234)..(234): n is a, c, g, or t
  modified_base (472)..(472): a, c, t, g, unknown or other
  misc_feature (472)..(472): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctcccgtggctgtgtctcgtgggcgaggacgggcctaccatcaactgacaacgtccagccagtacttgtttaatacagtcctacaaanaaataagaactacttagcttaggtatacagacaacgaaccgaggacacgacctacctaacgtcactactagtttacgacggactacgtaccggtaccgggtaccggtcccgggtacccgtacggaccgtagttaccgaggtacgccggtagggccgggtacggtacgggtaactaacggttactttaccgaccttacctaccaactaacgtaccaaaccgtacgtccgtacgcgaggngtacggaggtgtacggtggtacgtttaatttacgtaccttggtacctaggtaacttaaggtttaactttaacgtaaccttaccgttaccccgttacccggttaacgggttaacccggaaccgggtaaacgggtaaccggttaaagggtaacggtaaaaccttaacggaaaccggtacgttaggccggtaactacggtacctaacttacgttaccgtttacgttccctttactaccccgttaccggttacccgaccgttactacgtttaaaccg

SEQ ID NO: 169289 - DNA, 625 bp, Homo sapiens
  misc_feature: GYAE6OF01DWISZ.37.11.A11.1.454.CMB.1.raw
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgttttanacagctccaaacaataaagaactacttagcttggtatcagcaagaaaccagggcagcctacctaaactgctcatttacgnggcatccgtaccgggacgtcccggggtcctggaccgtattcgagtcggcgagcgggtctggacagtactttcactctccaacctataccaacacgcctgacgaggctggaggatggtcggtacttatttattacgtgtcagtactaagtttattaacgtacttacctccgtccggtacggtttccggaccgtaaacgggtacccgtaagggtaacgaaacgtaccaaaaccggtacgttaggtacggtcgtacgacccgtaactacgttccgttacggtttacccttacgtacccgttttaccccttacccccggacccttaagttcccgtaaacg

SEQ ID NO: 169290 - DNA, 766 bp, Homo sapiens
  misc_feature: GYAE6OF01C2TRP.37.11.A11.1.454.CMB.1.raw
  modified_base (215)..(215): a, c, t, g, unknown or other
  misc_feature (215)..(215): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtctccagacctcctggctgtgtctcgtgggcgagacgggcctccatcaactgacaagtccagccagtacttgtttanacagcctaccaaacaaataaacgtaacttacgttagtcgttaggtactacgaagaccaaacggaaaccgagggaccaacgtaccctaacctaaactcgtaccttactaagtttaccgtcgggacctaaccggtacccggtacccggggtaccggttcccggggtaccctacggaaccgtagttacggacggtcggaccgtacgggtccgggtacgtacgggtaccgtagttacttcctaccttacctacctaaccgactaccaaaccgtacgtcccgtaggaccgtacgggacgtagggaaggttacgttcgggtacgggtactttaattttaacgttacgtacggtacacggttactaaagtttattaacgttaacttacccgttacccgttaccggtaccgttaccgggaaccgaaacggggtaaaccgaagggtaacgtaactaaccgtaaacgtacgttccggtagtacccgtacggtaccacctaacgttcgttaccggttaccttaccgtacctttccccgtaccctcccgtattaccggtaacg

SEQ ID NO: 169291 - DNA, 807 bp, Homo sapiens
  misc_feature: GYAE6OF01C55GL.37.11.A11.1.454.CMB.1.raw
tcagtagtgtagatcacgaccggtgctcgatttagctacgactgcaggggcagcaagatggtgttgcagacccaggtcttcatttctctgttgctctggatctcgtggtcgccgtacggggacaccgtgatcgacccagtctcagcctccgtggctgtcgtctcggtagggcgaggaccggccctacactacaacgtcgacaacgccacgaccgtagtacttagtttaacacgactacctaaacaaacgtaaaactaacgaaactttaccttaggtacctttaggtaacacgaacgaacgtaaaccggaaaccgcggacgaacgtacccttaaccgaaacgttcgccttactaacgtttacggacggactaccgtaccggtaccccgggtacgggtacccggtcctacgaccgttacgtacggacgtcggacggaggtcggtacgtaacggctagtacttccacgttacacgtacactaaccgacgtacgtccgtagacccggtaggcggtaagaggtacggttcgtacggttaacgtttaacgtttaacgttacgtaacggtaccgtaaggttaacttaacggtttaaacttaaacctaacccggtttaccgttaccccgttacgggttaaccggtacccggggtaaaaccgtaaaaccggggtaacgttaaaacgggtaacggtaaaacccgtaaaccggttaaaccgtaacggtggtaaacccggtcgtaacccgtaccgtaaagttccgtacgttacccgttactaccgttacctacccgtacctacgtaacctagttaaccg

SEQ ID NO: 169292 - DNA, 532 bp, Homo sapiens
  misc_feature: GYAE6OF01A36Q8.37.11.A11.1.454.CMB.1.raw
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctctatttactgggcatcgtacccgggagtcccggggtcctgaccgattcagtggcagcggtntggacagattcactctcacatcaacagcctgcaggcngaggntggtgcgtatttagtactgtcagactagtattactaatacctccgtcgtacgttcggaccgaacgggtaccgaagggtacgaaactacgaaacgtacgtggtacgcgtcgacctacatctacgttctctacttcctacccgtctatcgtaacg

SEQ ID NO: 169293 - DNA, 696 bp, Homo sapiens
  misc_feature: GYAE6OF01BC1ME.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggcctccatcaactgcaagtccagccagacttgttttatacagctaccaaacaaataaacgaactacttagtcttaggtatcagacaagaaaccagggcacgcctacctaaactgctctatttacgtggcacgtccgtacccgggacggtcccgggtcctcggaccgtattcgaggtcggcgaggcgggtcgtacggactagtactttcgacttcgtaccaaccgtataccaaacgacgtcctaggaccgacgggtctagggaggtagtggtacgggtacttaagttttacgttacgtcgtacgtagtactaagttaattaactaacgttacccttcccgtaccggtacggttaccggaaccgtaaacggggtaacccgtaagggtacggtaaaactaccggtaaaacgtacgttggtacggtaccgtacgacccgtaacctacgtttcccgttacggtttaccctttaccggtaccttttacccccgttaaccccgtacccttaaacgtttccgttaaaaccg

SEQ ID NO: 169294 - DNA, 705 bp, Homo sapiens
  misc_feature: GYAE6OF01D8WIW.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttanacagctaccaaacaataagaactacttagcttaggtatcagcaagaaaccagggcacgcctacctaaactgcttctatttacgtgggctacgtccgtaacccggggacggttcccgggggtccctacggaccgtattcgaggtcggcgaggtcgggtcgtagggacctaggtactttccacttcctaccaacctataccaacgacgccctaggcgagggtcgtggaaggtagttcggtagggtacttaagtttacgtttacgtagtaccaagtactaaggtttaactttaacgtaaccgtttaccgttaccccgtacccggttaaccggtttacccgggaacccgtaaacggggtaaccgtaaaggggttaacggaaaaccgttaccgaaaaacggtaccggttaggtaccgggaccttacggaccctaaccgtagttccgttcgttaccttaccgtaccgtttccccttacccgtaccttacgttccgtaaacg

SEQ ID NO: 169295 - DNA, 688 bp, Homo sapiens
  misc_feature: GYAE6OF01D0ZN7.37.11.A11.1.454.CMB.1.raw
  modified_base (211)..(211): a, c, t, g, unknown or other
  misc_feature (211)..(211): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctcagactcctggctgtgtctcgtgggcgagagggccctccatcaactgacaagtccagccagtacttgttttanacagcctaccaaacaataagaacttacttagtacttggtatcgagacaacgaaaccgaggcacgtacctaacctaaactcgctactagtttacgtggactacgtacccgtaccggggacggtcccgggtcctacgaccgtacttcgagtcggacgacggtcgggtacgtaggactaagttacttccgacttcctaccaaccgtactacgaaccgtacgccgtgacgtaacgggtctaggaacgggtagttacgggtgggtaacctttagttttaacgttccgtagtccgtacggtattaacgtttaattaaccgttaaacctcgttacccgtaccggtaacggttaccggaacggtaacgggtaacctaagggtaacgaaacttaccgaaacggtagtcgtacgacgtaccgcgtaaccttagtcttaccggttcccttacgtaccttcccgttaacccggccttaagttcgttaac

SEQ ID NO: 169296 - DNA, 869 bp, Homo sapiens
  misc_feature: GYAE6OF01E3FG4.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttatacagctaccaaacaaataagaactacttagctttggtatcagacaagaaaccgagggcacgcctacctaaactgctctatttacgtgggcagtccgtacccggggacggtcccgggtccctggaacccgtatttcgaggtcggcgaggtcgggtcgtagggaacctagtacgttttaccacttcctaccaaccgtaactaccgaaacctacggtcccgttaggacctaaggggtccttaggggaaggttacggttgggttcggggaacccttttaaagtttttaacgtttaaccggttcggttaacccgtaaacggttaccgttaaaaggttttaaacttttaaaacgttaaaaccctttaccccggtttaacccccgtttaccccggggttaaacccgggttttacccgggggaaacccccggttaaaaacggggggtaaacccttaaaacgggggtttaaccggtaaaaaaccgtttacccggtaaaaaaacccgggtaacggtttaccgggtttacgggacccccgtttaaggaaccccccgaaacgtttaaccgtttccctttaacgggtttacccccctttttaaccggttaaccccgtttacccccgttttaaccccccccgaccgttttaaaagttccccgtttaaaaccgg

SEQ ID NO: 169297 - DNA, 611 bp, Homo sapiens
  misc_feature: GYAE6OF01DYPDB.37.11.A11.1.454.CMB.1.raw
  modified_base (213)..(213): a, c, t, g, unknown or other
  misc_feature (213)..(213): n is a, c, g, or t
  modified_base (303)..(303): a, c, t, g, unknown or other
  misc_feature (303)..(303): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgagagggcctccatcaactgcaagtccagccagtacttgttttanacagctaccaaacaaataagaacttacttagtcttaggtatcagacaagaaaccgagggcacgtcctacctaaactgctactatttacgnggctacgtaccgtaccgggacgtcccggggtcctagaccgtattcgaggtcggacgacggtcggtcgtaggactagtacttcactctacacatcaacgcgctagcgaggcgtaggagtgtggtgtacttatttagtctagtacagtactaagttacttaatacttacctccgtacgtacggtaccggaccgaagggaccgtaaggtaacgaaactacgaaacgtacgtggacgtaccgtacgactacctagttccgttacgttactttacctacccgttcccttacccccgacttacgtccgtaaacg

SEQ ID NO: 169298 - DNA, 633 bp, Homo sapiens
  misc_feature: GYAE6OF01ASV2H.37.11.A11.1.454.CMB.1.raw
  modified_base (220)..(220): a, c, t, g, unknown or other
  misc_feature (220)..(220): n is a, c, g, or t
  modified_base (343)..(343): a, c, t, g, unknown or other
  misc_feature (343)..(343): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaanaataagaactacttagcttggtatcaagcaagaaaccgagggcagcctacctaaactgctcattactgggcatccgtaccgggagtcccgggtcctgacctattcgaggtgcgaggcgggtcngggactaggtattcgacttccgtcacctatacaaccagcctgctacggcgtaggaaggtgtggtcggtacgttaattttacgttacgtggtaccgaagtactaagtttaatttaataaaccgttacctaccccgtaccggtaccggttaccgggaccgtaaacggggtaacccgtaagggtaacgaaacgttaccgaaacggtacgttggtacggtacttacggacctaacctgttaccgttcggttaccttacgttaaccttcccgttacccccgctaactcgttaacg

SEQ ID NO: 169299 - DNA, 670 bp, Homo sapiens
  misc_feature: GYAE6OF01CXGQS.37.11.A11.1.454.CMB.1.raw
  modified_base (213)..(213): a, c, t, g, unknown or other
  misc_feature (213)..(213): n is a, c, g, or t
  modified_base (300)..(300): a, c, t, g, unknown or other
  misc_feature (300)..(300): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatcaactgacaagtccagccagtactgttttanacagctacaaacaataagaacttactagcttaggtatacagacaagaaaccaggaacacgcctaactaaatcgactactatttacgngggtacacgtaccgtacccggggacgttcccggggtacctacggaccgtattccgaaggtcggacgacgggtcgggtacgtagggaactagtacttccactacctacaacctatacgaaacgacgtccgtagaccgagggtctaacgggaaggtagttgggtagtacgttaattttactacgtggtaccgaagtctaaagttacttaacttaacgtacctacccgttacgtacggttaccggaaccggtaaacgggtaccgtaaaggtacgaaaactaccgtaaaacggtcgtaggtcgaccgtacgacccgtaactacgttcgttacgtactttacctacgttaacccgttcccacttacgtctaaacg

SEQ ID NO: 169300 - DNA, 798 bp, Homo sapiens
  misc_feature: GYAE6OF01BLJU6.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacaccgtgactcgacccagtcctccgagtaccctcccgtggtctgtcgtctcgtcgggcgaggacggtccctacataccaacgtcgaccacgtccacgacctaacgttacttttacgttttaacaccgacgtaccctaaccaaaaactaaacgttaaacgtaacctttacgttacggtcgtttacggtactacgaacgtaaccgaaaacgaaaaccggcgggacctaaccgtacccttaacctaagtccgtaccttacttacgtttacggcggaccttaccggtacccgggtaaccccggggtccggggttccccgggttacccacgggttaacccgttacgttacggacgggtccggacggtacggggttccgggttacggaacggtaaccgttacgtttacccttaccaccgtttccaaccctaaccgtacctaaaccgtacccgtacggtcctacggcgtaacgggtcgtagggtaacttggtacgggtcgttaactttatttacgtcgtacggactagtacgttaatttaccaacttccgttaccgttccgtaccggttacgaaccgaacgggtaacgtaacggtagaacgtaacaccgtaaggctgggtctacgtacaaccttcgtacttacgttcttacctacgttccctccctaccgcttacgtcgtaacg

SEQ ID NO: 169301 - DNA, 653 bp, Homo sapiens
  misc_feature: GYAE6OF01EES1W.37.11.A11.1.454.CMB.1.raw
  modified_base (211)..(211): a, c, t, g, unknown or other
  misc_feature (211)..(211): n is a, c, g, or t
  modified_base (295)..(295): a, c, t, g, unknown or other
  misc_feature (295)..(295): n is a, c, g, or t
  modified_base (413)..(413): a, c, t, g, unknown or other
  misc_feature (413)..(413): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagagggcctccatcaactgcaagtccagccagacttgttttanacagctaccaacaataagaactacttagcttaggtatcagcaagaaccgagggcacgcctacctaaactcgactctatttacgnggactacgtccggtacccggggacgtcccggggtccctaggaccgtattcgaggtggcgaggtccgggtcgtagggactagtactttaccgacttccgtaccaacctactaccgaacncgtcccgtgaccgacggtcgtaggaggtagttcggtacgggtacgttaattttacgttacgtcgtacgagtactaagttatttaactaacttacctccgtaccgtacggttaccggaaccgtaagggtaccgtaagggttacgaaactacgaaacgtacgtacggtacgtacgtacgacctacgtacttcgttcgttaccttaccttaccgttacccttaccccgcttagtccgttaacg

SEQ ID NO: 169302 - DNA, 568 bp, Homo sapiens
  misc_feature: GYAE6OF01EFEW0.37.11.A11.1.454.CMB.1.raw
  modified_base (208)..(208): a, c, t, g, unknown or other
  misc_feature (208)..(208): n is a, c, g, or t
  modified_base (359)..(359): a, c, t, g, unknown or other
  misc_feature (359)..(359): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctcaacaataagaactacttagcttggtatcagcagaaaccagggcagcctacctaaactgctcatttactgggcatcgtacccggggagtcccggggtccctggaccgattcgaggtggcgagcgggtctggacagtattcactcncaccatacaacagcctgcgaggctggaggatggtggtacgtatttatactgcagtctaagttattaattaacttacctcctcgtaccggtttacggacccgaaaggggtacctaagggtacgaaactaaccgaaacgtaacgtggtaggcctagcctaccattccgttacgttccttactccttacccttaccccgactacgtctaacg

SEQ ID NO: 169303 - DNA, 798 bp, Homo sapiens
  misc_feature: GYAE6OF01DJZBD.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatcaactgacaagtccagccagtacttagttttacacagcctaccaaacaaataagaacttacttagcttaggtatacaggaccaaacggaaaccgagggaccaacgtaccctaacctaaaactcgtactactaacgttttacgaggggtacctaacggttacccggtaccggggtacggttccccggggtcctaggaaccgtagttacgacggtcggacgtacgggtcggtacgtacgggaactaggttacttccacgtacctaccaactactaccaaacgtcgtaccgtagacgtacggacttaggacggtagtcggtacgggtactttaactttaacgttacgtacgtacgaagtacttaaggtttaacttaacttaacgttacccgttcccgtaccgggttaaccggtttaccgggaaacccggtaaaggggtaaccgtaaagggggttaaccgtaaaaccgtaaccggtaaaacggttaaccggttagggtaccggtaccgttaaccggaaaccttaacccgttaacgtttaccgttacccggtttaccttaacccgtttacccgttaacccccgtttacccccggaacttaaccgtttaccggttaaaaccg

SEQ ID NO: 169304 - DNA, 628 bp, Homo sapiens
  misc_feature: GYAE6OF01EX7QJ.37.11.A11.1.454.CMB.1.raw
  modified_base (208)..(208): a, c, t, g, unknown or other
  misc_feature (208)..(208): n is a, c, g, or t
  modified_base (615)..(615): a, c, t, g, unknown or other
  misc_feature (615)..(615): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctgctgtgtctctgggcgagagggcctccatcaactgcaagtccagccagacttgttttanacagctaccaaacaataagaactacttagcttggtatcagacaagaaaccgagggcacgtcctacctaaactgctctatttacgtggctatccgtacccggggacgtcccggggtccctgaaccgtattcgaggtcggcgaggcgggtcgtgggactagtactttacactctacaccatacaaacacgcctgcgaggctaggaggtatggtaggtacgttaattttagttacgtcgtacagtactaagttaatttaataacttacccttcccgtaccggtaaccggtttaccggaccgtaaacggggtaaccgaaagggttaagaaacgtaacgaaaaccggaacgttggtacggaccgtacgacctaacctattccgtcgttacttcctaacttcccttaaccccnctacttccgtaac

SEQ ID NO: 169305 - DNA, 709 bp, Homo sapiens
  misc_feature: GYAE6OF01CCVGO.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatcaactgacaagtccagccagtacttgttttatacagctaccaaacaaataagaacttacttagcttggtactacgagacaacgaaaccgagggcaacgcctacctaaactgacctctactttacgtcgggactacgttccggtacccggggtacggttccccggggtccctacggaccgtatttacggaggtcggacgtacgggtcgggttcgtacgggaactaggttactttaccacttccgtacaacctataccaaacgacgccgtgacgtacgggtacgtaggacggtgtcggtacggtacgttatttacgtacgtgtacgaagtacttaagttaatttacgtaactttacccgtacccgttaccggtaccggttacccgggaacggtaaccggggtaacgtaaaggtacggaaacgttaccgaaacggtacgttacggacggtaccgtacggacctaaccttacggttcctacgttaccttaccgttaccgttaccccgttacccacgttacgttccgtaacg

SEQ ID NO: 169306 - DNA, 544 bp, Homo sapiens
  misc_feature: GYAE6OF01E18X5.37.11.A11.1.454.CMB.1.raw
  modified_base (208)..(208): a, c, t, g, unknown or other
  misc_feature (208)..(208): n is a, c, g, or t
  modified_base (367)..(367): a, c, t, g, unknown or other
  misc_feature (367)..(367): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactactagcttggtatcagcagaaaccagggcagcctcctaaactgctcatttactggcatctaccgggagtccggggtcctgaccgattcagtggcagcggtctggacagattcactctcacatcaacagcctgcaggcnggagatgtggcgtatttactactgtcagcaagtattataatcctcctcgacgttcggaccgaagggtaccaaggtagaaatacgaaaacgtactgtacggtctcggacctaaccgaattccttacggttacctttaccgaactttccccgttacccccgactaacgtccttaaacgg

SEQ ID NO: 169307 - DNA, 762 bp, Homo sapiens
  misc_feature: GYAE6OF01CGVCK.37.11.A11.1.454.CMB.1.raw
  modified_base (215)..(215): a, c, t, g, unknown or other
  misc_feature (215)..(215): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatgacccagtcctccagacctccctggctgtcgtctcgtgggcgagacgggcctccatcaactgcaagtccagccagacttgtttanacagctacaaacaaataagaacttacttagctttggtatcagacaacgaaaccgagggacacgacctacctaaacgtgtacctactaagtttaccgtagggacctacgttacccggtaaccccgggggtacgttccccgggggttaccctacggtaacccggtaacgtttcggaacggttcgggaccgacggggtccggggttacggtacgggaaccgtaggttaaccgtttccaccgttacctaccgaacctaatacccgaacgtacgtccgttaggtacggacgtaggaggtacgtggtacggtacgttatttacgttagtacgtacgacgtacgtaagttaagttaacttaacttaccgttaccgtacccgttacgggttaccggaaccggaacgggtaacccgtaaagggtaacgtaaacgttaaccgaaacggtaacgtaggtacggtaccgtaacgtaccgaaccgttattacgttccgtttaccttaccgttaaccgttccccgttaccccgtaacctaccttacgtaccggtttaaacc

SEQ ID NO: 169308 - DNA, 708 bp, Homo sapiens
  misc_feature: GYAE6OF01CMDAB.37.11.A11.1.454.CMB.1.raw
  modified_base (212)..(212): a, c, t, g, unknown or other
  misc_feature (212)..(212): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagacgggcctccatcaactgcaagtccagccagacttgttttanacagcctaccaacaataagaactacttagcttggtatcagacaagaaaaccgagggccacgaccctacctaaactcgccttactaacgttttaccgtggggacctacgttacccggtaccccgggggtacggttccccggggtcccctacggacccgtacttcggacggtcgggcgacgggtccggggtcgtacggggactaggtactttccgaccttcgtaccacctaactaccaaacgcgccctagacgacggtccgtgggtaacggtagttcggggttaggacgtttaattttacgttaacgtggtacgagtcttaaagttaacttaacgttaattaacccttcccgtaccggttaccggttaccggaaccgaacggggtaaccgtaaagggtacgtaaacttaccgaaaaccggtactagggtaccgtacgtacaccgtacctaagttccttagttaccttcctacttcccgttacccacctattcgtaacg

SEQ ID NO: 169309 - DNA, 702 bp, Homo sapiens
  misc_feature: GYAE6OF01DS7K0.37.11.A11.1.454.CMB.1.raw
  modified_base (293)..(293): a, c, t, g, unknown or other
  misc_feature (293)..(293): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttatacagctaccaacaataagaactacttagcttggtatacagcaagaaaccgaggcacgcctactaaactgctactagtttacgnggacacgtccgtaccggggacggtcccgggtcctgaccgtattcgaggtcggacgaggtcgggtcgtgggactagtactttccacttctccaaccactacaaacgacgcccgtagacgtagggtccgttaggacgggtacgttgggtacgggttacgtttaagtttttaacgtttaccgttcggttaacgaaggtaccgtttaagtttaaattttaacttaaaccgtttacccttaccccgtttacccgggttaaccggtttacccgggaacccggtaaacggggtaacccgtaaaggggttaacgtaaaactaccgaaaacggtaccgtagggtacgtctacggacctaaccgtacttccgtacgtttccttacttaccttcccgttacccctactacgttcgtaacg

SEQ ID NO: 169310 - DNA, 745 bp, Homo sapiens
  misc_feature: GYAE6OF01BERG9.37.11.A11.1.454.CMB.1.raw
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagacgggcctccatcaactgcaagtcagccagacttgtttanacagctaccaacaataagaactacttagcttgatcagacaagaaaccgngggcacgtaccctacctaaaactgtaccttactaacgttttaccgnggggacctaacgttcccggtaacccccggggtacggtccccgggttccctacggtaacccgtatttccgagggtcggccgtaagggccgggttaccgtagggaacgtaacgttactttccacgttaccctccaaccaagtacctaaacctcggacccgtgaccggtacggtccgtaggaacggtagtggttacgggtacgtttaacttttacgttaccgtagtaccgtaaggtacgtaaggtttaactttaactaacttacccgttacccgttaccggtaaccggttaccggaaccggtaaccgggtaacgtaaacggtacgtaaaacgtaccgaaaaacgtacgtacggtaccgtacgtaccgtacctaacgtaccgtttcttaccggttaccttacccgtaccgtttacccttacccccggacttccttacgtaaccg

SEQ ID NO: 169311 - DNA, 692 bp, Homo sapiens
  misc_feature: GYAE6OF01ASB6G.37.11.A11.1.454.CMB.1.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaacaataagaactacttagcttggtatcagcaagaaaccagggcagccctacctaaactgctctatttacgngggctacgtccgtacccggggacggtcccggggtccctggactgacttcgaggtcggcgaggtcggggtcgtggggaactaggtactttccgactcctaccaacctataccaaacgcgtacctggaccagggtcctagggaggtacgtgggtacggtacgttaattttacgtttacgtcggtaccgaaggtactaaggtttaactttaaacgttaacgttacccgttacccgttacccgggttaaccggttaccgggaacccggtaaacggggtaaccctaaaggggtaacgtaaactaccgaaaacggtaacgtcggtacggacgtcggaccctaacccgttgttacccgttagttaccctttaccgtacgtttccccgttaccccgtacctacgttaccg

SEQ ID NO: 169312 - DNA, 800 bp, Homo sapiens
  misc_feature: GYAE6OF01AQD6W.37.11.A11.1.454.CMB.1.raw
  modified_base (781)..(781): a, c, t, g, unknown or other
  misc_feature (781)..(781): n is a, c, g, or t
tcagtagtgtagatcacgaccggtgctcgatttagctacgactgcaggggcagcaagatggtgttgcagacccaggtcttcatttctctgttgctctggatctcgtggtcgccgtacggggacaccgtgactcgacccagtcctccagacctcccgtggctggtgtctcgtgggcgaggcggcctcgatacaactgacaacgtccagaccagtactttgttttaacacgacgtacctaccaaactaaagtaacgtaacttacgttagtcgttaggtactcgaagaccaaacggaaaccgcggacacgtaccctaaccgtaaatcgacttacgtaacgtttacggcggtaacctaccggttacccgggtaacccggggtccgggttccccgggtaccctaggaaccgttacgttacggagggtaccgggtaccgtacggggtcccgggtttacgggacggaacccgttaaggtttaccctttaccgaccttaccgtaccgaaacctacggtaaccaaccggtcggtcccgtagggtaccggtacgttacggaacgggttacggtacggttacggggttaccggttaactttaacgtttacctacggacgtacgtaagtacgttaagttaacttaccgtactcccgtacccgtacgggtacggtaaccgaacggaacggtacggaagtaaccgaacgtaaccgtaagtcgacgtcgtaaccgtacgtacctacggttactcgttaaccctccgtttaacctccggtttaccccgaacccgttntaaccgtttaccgtaaacg

SEQ ID NO: 169313 - DNA, 703 bp, Homo sapiens
  misc_feature: GYAE6OF01ADOR7.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaccagggcagcctacctaaactgctctattactgggctatccgtacccgggagtcccgggtccctgacccgtattcgagtggcgaggccggtcgtagggactagtactttcgaccttccgtaccaaccgtactacccgaaaccgtacgtacccgttaggaccgtaacggggtccgttagggaaggttacgttcgggttacgggtacgtttaatttttaacgttaaccgttcggttaccaaggttaccgtaaaggtttaacttttaaacgtaaaccgtttacccgttaccccgtttacccgggtaaccggttttacccgggaacccggtaaacggggtaacccgtaaggggtaacgtaaaccgtacgaaaaaccggtcgtacggtacggactacgacctaacctatccgttcgttaccttctaacgttccccttacccacctattccgtaacg

SEQ ID NO: 169314 - DNA, 748 bp, Homo sapiens
  misc_feature: GYAE6OF01BDOOS.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttaatacagctaccaaacaataagaactacttagcttggtatcagcaagaaaccgagggcagccctacctaaactgctctatttacgtgggacacgtccgtacccggggagtcccggggtccctaggaccgtacttcgaaggtcggacgacggccgggtcgtagggactaggtactttccactcctccaccataccaactacgccgtgcgagggtcctaggagggactagggtgggtaccgttaattttaagttaccgttaggtacctaaggtaccgttaagtttaaatttaagttaaaaccttacccgttacccgtcccggttacggtttacccgggaaccggtaaacggggtaacccgtaaagggttaacgtaaaacgttaacccggtaaaaaccggtaccgtttacgggtacgggtacccgtttacggaaccccgtaacccttaacggtttccccggttaccgtttaaccccgttttaccctaaccgttttacccccctttaccccggacccccgttaaagtttccccggtttaaaccgg

SEQ ID NO: 169315 - DNA, 757 bp, Homo sapiens
  misc_feature: GYAE6OF01DEG65.37.11.A11.1.454.CMB.1.raw
  modified_base (329)..(329): a, c, t, g, unknown or other
  misc_feature (329)..(329): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatcaactgacaacgtccacgccagtactttaggttttacacgacgtacctaccaaactaataaacgtaacttacttagtcgttaggtactcgagacaacggaaccgagggacacgtcctacctaaacgtcgtactctaacgttttacgngggactacgtccggtacccggggtacggtcccggggtccctaggtaccgtatttcgaggtcggaccgagggtccgggtacgtcgggaactacgttactttaccgacttcccgtactacctactacccgaaactacgtaccctaggacgacgggtacgtaggtaaggtagttcgggtaggtacgtttaagtttaacgttacgttcggtacgacgtaccggttaagtttatttaaaccgttacttacccgttacccgttaccgggtaacggtttacccgggaacggtaaacggggtaaccgttaacgggtaaggtaaacctacgaaaccggtacggtcggtacgggtactaccggtaacctaaccggtctttccgttagttacccgttacctacgtttaccccttcccggtacctagtttccgtaaaccg

SEQ ID NO: 169316 - DNA, 785 bp, Homo sapiens
  misc_feature: GYAE6OF01EDBEP.37.11.A11.1.454.CMB.1.raw
  modified_base (302)..(302): a, c, t, g, unknown or other
  misc_feature (302)..(302): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttatacagctaccaaacaataacgaacttacttagtcttaggtatcagacaacgaaaccgagggccacgacctactaactcgctactactttacgnggtacacgttccggtacccggggtcggtcccgggtaccctcggaccgtattcgaggtcggacgtacgggtcgggtcgtacgggactaggtactttccaccttcgtacctaacctactaccgaaaccgtaccgtacccgttacggaccgtaacgggtccgtaagggtacgggtaagttcgggttaacgggtactttaaacgtttttaacgttaccgttggttaaccgaggttaccgttaaagttttaacgttttaaacgtttaaccctttaaccccggtttacccgttaacccgggttaacggtttaaccccggggaacccggtaaacggggtaaccgtaaaggggtaacgtaaaacgtacccggaaaacggttaacgttggtaccgggtccttaacggacccgtaaccttacgtttccgttaccgttacctttacccgtacccgtttaccccgttaacccccgacttaacgttccgttaaacg

SEQ ID NO: 169317 - DNA, 735 bp, Homo sapiens
  misc_feature: GYAE6OF01BB9RW.37.11.A11.1.454.CMB.1.raw
  modified_base (724)..(724): a, c, t, g, unknown or other
  misc_feature (724)..(724): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggccctccatcaactcgcaagtccagccagacttagttttactacacgctaccaaacaataaacgaacttacgttagtcttaggtatacagacaaaggaaaccgagggaccacgacccttaaccgtaaaacctcgccttactacgttttacgtacggggcctacgttccggtaaccccggggtacgggttccccggggtaccctcgggtaaccgtagttccgagggtcggcgtacgggccgggttcgtacgggaactacgtacgttactaccgttctacctaaccactaccaacgtacgtcctacggacgtcggtaccgtgggaaaggttcggttcgggtagggttaacctttaaagttttacgttaccgtgttaccgtaggtacgttaaagtttaacttaattaacgttcccttacccggttcggtaaccgggtttaccgggaacccgaaaggggtacccgtaaagggtacaaaacttccggaaaacgttggtcgtacgcttacggacctactacgttcctttacgctttacgaccttcccgtaacccgnttctccgtaac

SEQ ID NO: 169318 - DNA, 630 bp, Homo sapiens
  misc_feature: GYAE6OF01CDRZD.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagagggcctccatcaactgcaagtccagccagactgttttanacagctaccaacaataagaactactagcttggatcagacagaaaccgaggacacgtacctacctaaactcgctctaattacgtggcacgtccgtacccgggacggtcccggggtccctggaccgattcgacgtggcacggtcgggtcgtgggactagtacttcactctcacctataccaacacggtcctggacacgggctcggaggtagtcggtggacttatttattacgtgtacaggtactagttaatacttaactcccgttacccgtccggtaaccgttaccggaccggaaacgggtaccgtaaagggtacggtaaatacccggaaaagtaccgttggtaccggcgttaccgaccgtacctacgtttcgtacttccgttacctcttaccccggtcctaccccgttagtccgttaaccg

SEQ ID NO: 169319 - DNA, 656 bp, Homo sapiens
  misc_feature: GYAE6OF01CSPFZ.37.11.A11.1.454.CMB.1.raw
  modified_base (214)..(214): a, c, t, g, unknown or other
  misc_feature (214)..(214): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggagggcctccatcaactgcaagtccagccagtacttgttttaanacagctaccaaacaaataagaacttacttagcttggtatcagaccaagaaaccgagggccaacgccctacctaaactcgactctatttacgtgggacctacgtccgtacccggggacgtcccggggtccctcggaccgtagttcgaggtcggcgtacggtcgggtcgtggacagtactttccactctaccacctatacaaacacgtccctagccgaggccgtaggacggtagtcggtacgggtacttattttacgtacgttcgtacagtactaagttattaacttaactaccgttcccgtaccggtccggtttacgacccgtaaagggtacctaagggtaacgaaactacgaaaacggtcgtaggtccgtactaccgacctacctacgttccttacggttaccttacgtaaccttcccgttacccgaccttgtccgttaacg

SEQ ID NO: 169320 - DNA, 604 bp, Homo sapiens
  misc_feature: GYAE6OF01AHWJ9.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagacagaaaccgaggcagcctcctaaactgctcatttactgggcatccgtaccgggtacgtccggggtccctgaccgtattcgagtggcaggcggtcgtcggtacgacgtagttactctcctcacctactacaacgacgcgtcgcgacggcgtacgtaggagtgtggtcgtatttattacgttgtcgtacgacgtagtaattattaactacttccgtaccgtaccggttaccggtaccggaaccggtaacggtaacggtaaggtaacgtaactaaccggtaaacgtacgttacggtacgtacgtcgtacccacttccgttacgtcgttctaacttccttaccccgccttacgtcgttacg

SEQ ID NO: 169321 - DNA, 672 bp, Homo sapiens
  misc_feature: GYAE6OF01DFFZ9.37.11.A11.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (602)..(602): a, c, t, g, unknown or other
  misc_feature (602)..(602): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtcctccagacctccctggctgtgtctctgggcgagaggcctcatcaactgcaagtccagccagacttgtttanacagcctaccaaanaataacgactactagtcttaggtatcagcaagaaaccgagggcacgcctacctaaactcgtctactagttttacgnggacctacgtccggtaacccggggtcggtcccggggtccctggacctattcgaggtcggcgtacggtccgggtctacgggaacctagtaacttttcccaaccttcctacccaaccgtacgttaccgaacgtcccaacggtcccttaggacccgtaacgggtacttacggtaaaaggtcgttcgggttacggtacgttttaaggttttactttcccgtagtccgttggacttaggtttacgtttcggtaacccttccgttacggtaccgtttcggacgtacggtacggaccgtaggtgacgtanaccgagaccgtagtcggtcgctcgtccgaaccttgtaccgttcgttccttaccgtcctcccgtcccgtac

SEQ ID NO: 169322 - DNA, 641 bp, Homo sapiens
  misc_feature: GYAE6OF01BA1E2.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtactgttttaatacagctaccaaacaaataaagaacctacttagtcttaggtatcagacaaggaaaccaggacacgaccctacctaaactgctctaagtttacgtggctagtccgtacccgggtacggtcccgggtccctcggtaccgtagttcgacggtggacgacggtccgggtcgtaggactaggtactttacacgttcctactaaccactacgaactcgctacgcgacggtctgggagtatgtgggactttaatttagtacgtcgactagtagtaagttaattaataactaccgttcccgtaccggtaccggttaccggaaccggaacgggtaaccggtaaggttaacgaaacgtaccgaaaggtaaccgtgtacggctacgactacctaagtccgttactacgttctccgtttaccctacccgcttaatccggtaaac

SEQ ID NO: 169323 - DNA, 600 bp, Homo sapiens
  misc_feature: GYAE6OF01A3TYA.37.11.A11.1.454.CMB.1.raw
  modified_base (212)..(212): a, c, t, g, unknown or other
  misc_feature (212)..(212): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttaanacagcctaccaaacaataaacgaactacttagcttaggtatcagcaacgaaaccgagggcacgcctacctaaacgtgactctatttacgtgggacacgtccgtacccggggaggttcccggggtaccctagaccgtattcgaggtcggcgaggccgggtcgtaggacagtacttcgactcgtcacctataccaacacgcctagacgacggtctaggagtagtggtcggtacgtaatttagtactgtacagtctagttattatactacctccgtacggtcgttacggacgaacgggtacagggtaacaactacgaaacgtacgtggtacgtaccgtacgacctactacgtcttagtaccttacgactttccctcccgctactcgtaacg

SEQ ID NO: 169324 - DNA, 704 bp, Homo sapiens
  misc_feature: GYAE6OF01C1WDB.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagcgggcctccatcaactgcaagtccagcccagtacttagttttacacgacgtcctaaccaaacaaataaacgaacttacttagcttaggatacgaagcaaagaaacccgagggtaccacgtacccttacctaaaacgtcgtactcttaatttacgtgggtacctacgtccgtaacccgggaggttcccggggtccttaggaccgtattcgagtcggacaggcggtcgtaggacctagtactttcacttcgtaccaacctataccgaaaacgtcggactacgacgtagggtaccgttaggagggtaacttgggtacggttacctttaagttttaatacgtcgtacagtacgttaagtaatttaacgtaactacccggttaccttccgggtaacgttcggtaaacccggaagggtaaccgtaaagggtacgtaaaactacgtaaacgtaaccgttgacggtacctacgaaccttacctaggttcttacgttaccttaaccgtacttacccctacccgtaacctacgttcgtaaaacg

SEQ ID NO: 169325 - DNA, 760 bp, Homo sapiens
  misc_feature: GYAE6OF01DZXYY.37.11.A11.1.454.CMB.1.raw
  modified_base (216)..(216): a, c, t, g, unknown or other
  misc_feature (216)..(216): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatcgacccagtctccagacctccctggctgtcgtctcgtgggcgaggacggcctccatcaactgacaagtccagccagtacttgttttanacacgtacctacaaaactaataaacgtaaccttacttagcgtttggtaactcgacgaccaaggaaaccgagggaccacgacccttactaaaccgtcgtaccttacttaacgtttaccgcgggacctacgttacccggtaacccgggggtaccggtttccccggggtacctacggtaacccccgtagtttaccggacggttcggaccgtcgggtcgggtccggagggtactaacgtagtttacccacttccgtaccaaacccgtataacccaacgtaccggcccttagacgacggtacgtagggtaccgtagtcggttaggtacttaagtttacgtacgtagtacctaagttacgtaaacgtttattaacttaacgttaccctcccgttaccggttaaccgttaaccgggtaccggaaacggggtaaccgtaaagggtacgaaacctaacgtaacgtacgtcggtacgtacgtcgtaaccgtacttacgttccgtaccttacttacccgttacttccccgttacccgtacttcttaaccgtaccg

SEQ ID NO: 169326 - DNA, 807 bp, Homo sapiens
  misc_feature: GYAE6OF01DDVRO.37.11.A11.1.454.CMB.1.raw
  modified_base (220)..(220): a, c, t, g, unknown or other
  misc_feature (220)..(220): n is a, c, g, or t
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
  modified_base (398)..(398): a, c, t, g, unknown or other
  misc_feature (398)..(398): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgaatcgacccagtctccagactccctggctggtgtctcgtgggcgaggacgggcctccatacaactgacaagtccagccagtacttgttttaanacacgtcctacaaacaaataagaaacttacgttaacgcttaggtactcgacgacaacgaaccgagggcacgtcctacgtaaactntcctacgtatttacggnggacctaactccggtaccggggacgttcccgggtccgtacgaccgtattcggagttcggcgtacggcgggttccgnggaacagtacttcactcacctacgactacaaacgcgtcgtacgcgaacggtcgtacgggaggtaggtcgttacgggtaccgtttaagttttaacgttaccgttacggttacgaaacggtttaccgttaaacggttaactttttaaacttaaacccgtttacccgttttaccccgggtaaacccgggtaccgggttttaacccggggaaaacccgggttaaaccgggggtaaaccgtttaaaacggggggtaaaaccgttaaaaacccgtaccgggtaaaaaacccggttagttaccgggtaccgggttaacttaacccgggaactaccccgttaaggttccctttaccggtttacccttaactccccggtttaccctacccccggtactaccggtttaaccttaaacgg

SEQ ID NO: 169327 - DNA, 648 bp, Homo sapiens
  misc_feature: GYAE6OF01BAWIV.37.11.A11.1.454.CMB.1.raw
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttanacagctaccaaacaataagaactacttagcttggtatcagcaagaaaccagggcacgcctacctaaatcgctcatttacgnggacactcgtacccgggacgtcccgggtcccngaccgattcagtggcgaggcgggtcgtggactacgtattccactctaccgactactacaacagccctgcgtagcgtacgaggtgtggtacgtacgttaatttagttactgtacgtagtacgtaagttaatttaataactttaccttaccccgttccggtaaccggtttaccggacccggtaaacgggtaaccgaaacgggtaaggtaaaactaccggaaaaccgtaacggtagtaccggtaaccgtcggtacccaaccttacttaccgtcggtttaccttaccttaaccgttcccttaaccccgccttaaccgttcgttaaaccg

SEQ ID NO: 169328 - DNA, 602 bp, Homo sapiens
  misc_feature: GYAE6OF01DPX40.37.11.A11.1.454.CMB.1.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (390)..(390): a, c, t, g, unknown or other
  misc_feature (390)..(390): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgaggagggcctccatcaactgcaagtccagccagacttgttttanacagctaccaacaataagaactacttagcttggtatcagacaagaaaccagggcacgcctacctaaactcgctctatttacgnggcagtccgtacccggggacgtcccggggtccctggaccgtattcgaggtggcaggcggtctcgggacagtactttccactctacaccataccaacncgccctgccgaggctaggaggtactggtaggtcgttatttagtactgtacagtctaagttattaataactacccttccgtaccgtacgttaccgggaccgtaaacggggtacctaagggtaacgaaactacgaaaacggtacgtggtacggctacgaccctacgtacttcgtacgttccttacgtaccttcccgttcccgactgtcgtaacg

SEQ ID NO: 169329 - DNA, 623 bp, Homo sapiens
  misc_feature: GYAE6OF01BEY4U.37.11.A11.1.454.CMB.1.raw
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
  modified_base (560)..(560): a, c, t, g, unknown or other
  misc_feature (560)..(560): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagaggcctccatcaactgcaagtccagccagacttgttttanacagctaccaaacaataagaactacttagcttaggtatcagacaagaaaccgagggcacgtcctacctaaactgctactaatttacgngggcacgtccggtaccccggggaggttccccggggtccctaggaccgtattccgaggtcggaccgagggtccgggtcgtacgggactaggtactttccacgttcctaccaacctactaccaacgacgtcctggacgaggctaggtaggtagttggtggtacttagtttatacgtgtacagtctaagttaattataactaccgtcccgtacggtacgttaccggacccgaagggtacccgaaaggtacgaactacgaaacgtntggtacgactacgcctaacgtatcgtcgttacttccgtacttcccgttacccgcttactgtac

SEQ ID NO: 169330 - DNA, 923 bp, Homo sapiens
  misc_feature: GYAE6OF01EMNJK.37.11.A11.1.454.CMB.1.raw
  modified_base (896)..(896): a, c, t, g, unknown or other
  misc_feature (896)..(896): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatcgaccagtctcagacctcccgtggctgtgtctcgtgggcgagacgggcctccatcaactgacaacgtccacgaccgagtacgtttgttttaactaacgacgtcctaacccaaaactaaacgtaaacgtaactttaacttagtacgtttaggtaacttcgaacggaccgaacgaaaccgcgggaccaacggtaccctaccgtaaacgtcgtaccttacgttaacttttaccggtgggtacctaccgttacccgggtaaccccgggggttaccggtttaccccggggtacccttacggtaacccggttactttaccggacggttacgggtaccgtagggttcccgggtaggtacgggtaacctagttacccgtttacacccgttcctaccgtaacctacgtaaccgtaaacccgtcggtcctaccggacgtacgggtacgtagggtaaggttcggtacggttacgggtaccttttaaggtttaacccgttcgtacggttacgtaacgttaaccgttaaaggttttaaaccttacgtttaaaccgtttacccgttacccggttacgggttaaccccgttaaccggggtaaccccgggaaaacgggtaacccggtttaaagggtaaaccggttaaacgtaaacccggtaaaaccggttaccggttacggttaccgggaacccttacccgggtaaccctaacctttaacgttttccccggttacccgtttaatttacccccgtaacccgggttttaccctaaccccccgggtntttaaacccggttcccttaaaaccggg

SEQ ID NO: 169331 - DNA, 596 bp, Homo sapiens
  misc_feature: GYAE6OF01AMNGV.37.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctccagactccctggctgtgtctctgggcgagagggcctccatcaactgcaagtccagccagtactgttttanacagctccaacaataagaactacttagcttggtatcagcagaaaccaggcagcctacctaaactgactctatttacgngggcagtccgtacccgggacgtcccggggtcctgtaccgattcgagtgcaggcggtctggacagtattccactctcaccataccaaactcgcctcgcgaacggctacgaggagtggtggtacttaagttttactacgtgtacagtactagttaattaataaccttactaccgtaccgtaccggtttaccggaccggtaaagggaacccgtaaagggtacggtaaacctacgaaaaccggtacgtggtacggtcgtcgaccctacctatccgttgttaccttcctaacttcccttacccgctacgtctacg

SEQ ID NO: 169332 - DNA, 758 bp, Homo sapiens
  misc_feature: GYAE6OF01DLDS4.37.11.A11.1.454.CMB.1.raw
  modified_base (212)..(212): a, c, t, g, unknown or other
  misc_feature (212)..(212): n is a, c, g, or t
  modified_base (702)..(702): a, c, t, g, unknown or other
  misc_feature (702)..(702): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggaggcctccatcaactgacaagtccagccagtacttgtttanacagcctaccaacaaataagaacttacttagtcttaggtactacgacgacaaacggaaaccgagggacaccgtacccttacctaaaacgtcgacttacttaacgttttacgtcggggtacctaacgtcccggtaacccgggggtacgggttcccccggggtaccctcggaacccgttaacgttccggacgggtcggacgacggtcggggtccgtagggactaggtacctttaccgacctactaccaaccctaactaccgaaacgtcggtcccgtaggaccggtagggtccgttagggaacggttagttgggtacggtacgtttaatttaacgttctcggttacagtaccgttaagttaacttttaacgtaaccttacccgttcccggttaaccggtaccggttaccgggaacccggtaaagggtacccggtaaagggtttaacgaaacgtaaccgaaacggtacttgggtacgacctcggacctaccttnttaccgtcgttaccttacccttacgtttccccgtacccgaacctgttaaccgtaac

SEQ ID NO: 169333 - DNA, 700 bp, Homo sapiens
  misc_feature: GYAE6OF01CGOYH.37.11.A11.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtcctccagacctccctggctgtgtctcgtgggcgagacgggcctccatcaactgacaacgtccagccagtacttgttttanacagcctaccaaanaaataacgaacttacttagctttaggtatacacgacaacggaaaccgagggacacgaccctaacctaaacgtcgctactagtttacgcggtactacgtccgtaacccggggtaccgttcccggggtccctacggaacccgtagtttaccggaggtcggacgtacgggtccgggttacgtacggggtaactaacggttactttccgacctaccttaccgaacctactaccgaaaccgtcggtacccgtaggaccgtacgggtcgtagggacggtagttggtacggtactttacgtttacgtacgtgtaccaagtactaagtttaactaactactccgtccgtaccggtacgttacggaccgaacgggtactaagggtactaaacgtacgaaacgtgtcggcggtacctacgacctacgtacttccttacgtacccttacgaccttcccttacccacttagtccttaaccg

SEQ ID NO: 169334 - DNA, 619 bp, Homo sapiens
  misc_feature: GYAE6OF01EIAE4.37.11.A11.1.454.CMB.1.raw
  modified_base (212)..(212): a, c, t, g, unknown or other
  misc_feature (212)..(212): n is a, c, g, or t
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
tcagtagtgtagatcacgaccggtgctcgatttagctacgactgcagggcagcaagatggtgttgcagaccaggtcttcatttctctgttgctctggatctctggtgcctacggggacaccgtgatcgacccagtctccagactccctggctgtgtctcgtgggcgaggacggcctccatcaactgacaagtccagccagacttgttttaanacagcctacaaacaataaagaactacttagcttagtatcagacaagaaaccagggcacgcctactaaactgactactattttacgngggactacgttccgtaaccccgggggacggttcccggggtcctacggacccgtagttaccaggttcggacgacggtcgggtactagggactagtactttcacgtctacaccaatacaacngcctgacaggcgtagaggtatgtggtactattttacatcgtacagctaagttaattaactaactaccttcctacggacgtttacgggaaccgaaacggggtaaccgtaaagggtaacgtaaacgtacgaaaacgtacgtaggtcggtactcgacctaactactcgtcttcttacgtactcccgttacccgactatcgtaac

SEQ ID NO: 169335 - DNA, 737 bp, Homo sapiens
  misc_feature: GYAE6OF01BKKQP.37.11.A11.1.454.CMB.1.raw
  modified_base (388)..(388): a, c, t, g, unknown or other
  misc_feature (388)..(388): n is a, c, g, or t
  modified_base (729)..(729): a, c, t, g, unknown or other
  misc_feature (729)..(729): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtcctccagactccctggctgtgtctcgtgggcgaggacgggccctccatcgaactgacaacgtccacgccagtactttgtttttaacacacgacctaaccaaaactaaaagtaaacgtaaccttacgttacggctttaggtacacagaccaaacggaaaaccgtgggactagacccttactaaaactgacctactaattttacggcggactacgtacccggtaccccggggtaggttccccggggttacccncggaaccgttacttcggaaggttcgggacctaaggggtcccgggttaactcggggtaaacctacgtttacctttaccgaactttcccaccgaacctactaccgaaacctaggaccccgttggaccgtacgggtactagggacgttagtggtacggttaccgttagtttacgtaccgtgtaaccgtgtactaagttacttaacgtacttaccgccttaccgggagttaccggaacgtacgggaactaggtaaggtaactaacgaacggacgttacggtagaccgtacgcttaaccgtcgttacttcgttacctactaacccgttcccttaccggactccgtnttaaaccg

SEQ ID NO: 169336 - DNA, 660 bp, Homo sapiens
  misc_feature: GYAE6OF01BWNHQ.37.11.A11.1.454.CMB.1.raw
  modified_base (400)..(400): a, c, t, g, unknown or other
  misc_feature (400)..(400): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagcccagacttgttttatacagctaccaacaataagaactacttagtcttggtatcagcaacgaaaccgagggcacgcctacctaaactgtcttcatttacgtgggctacgtccgtacccgggacggtcccggggtcctcgaccgtattcgagtcggcgaggccgggtcgtagggtacaggtactttcactctccacctataccaacncgcctacggcgacggtcgtaggacggtagtcggttaggggtaccttaagttttacgtacgtcgtacaaggtctaagtttataacttaacctccttcccgtacgtacggttaccggaccgtaaacgggaccgtaaggggtaacgtaaacgtaccgtaaaaacggaccgttggtacggacgttacggacctaacccgtattccgttacggttcccttactaacccgttcccctttaccccggacttaacgttccgttaaacg

SEQ ID NO: 169337 - DNA, 809 bp, Homo sapiens
  misc_feature: GYAE6OF01DDPA8.37.11.A11.1.454.CMB.1.raw
  modified_base (451)..(451): a, c, t, g, unknown or other
  misc_feature (451)..(451): n is a, c, g, or t
  modified_base (738)..(738): a, c, t, g, unknown or other
  misc_feature (738)..(738): n is a, c, g, or t
tcagtagtgtagatcacgaccggtgctcgatttagctacgactgcaggggcagcaagatggtgttgcagacccaggtcttcatttctctgttgctctggatctcgtggtcgccgtacggggacaccgtgactcgaccagtcctccagacctccgtggtctggtcgtcgtcggtgggacgacggacggtccctaccataccaacgtcgactaacgtccacgcctagtactttagtttaacacgacgtacctaacaaactaaataacgtaacttcgttacgtacgttagtactacgacgaacgaaacggaaccggcggtacctaaccgtacccctaacgtaacgtcgtaccttacgtttaccggtttacggcgggtacctaccggtttacccggggtaacccggggtacccgggttccccggaccgttaaccggaccgtttacgttaccgggnggttaccgggacgtacggggtccgggttacgaacgggtactacgtttactaccgacctaccgacctaacgtctaaccgacgtcgtccgtaggacgtacggtgtaggtagtcggttgtacggttaatttacttacggtcgtagtacgtagtaacttagttaaaccttaccttacgtcccgtaccggtcggttaccggtaacgggaaccgtaaacgggtaacgtaaacggtacgtaaacgtaaccgggtaacgttacgttccgggaacgtacccgtcctaaacccgttnttaccggttccgtttctaaccccgtttaccctacgggtacccccttaccggtacttacggtaaccgttacc

SEQ ID NO: 169338 - DNA, 641 bp, Homo sapiens
  misc_feature: GYAE6OF01AX6F9.37.11.A11.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (281)..(281): a, c, t, g, unknown or other
  misc_feature (281)..(281): n is a, c, g, or t
  modified_base (454)..(454): a, c, t, g, unknown or other
  misc_feature (454)..(454): n is a, c, g, or t
  modified_base (598)..(598): a, c, t, g, unknown or other
  misc_feature (598)..(598): n is a, c, g, or t
  modified_base (628)..(628): a, c, t, g, unknown or other
  misc_feature (628)..(628): n is a, c, g, or t
tcagtagtgtagatcacgaccggtgctcgatttagctacgactgcagggcagcaagatggtgttgcagacccaggtcttcatttctcttgttgctctggatctctggtgcctacgggacaccgtgatgacccagtctccagacctccctggctgtgtctgtgggcgaggagggccctacatccaactgcaacgtccagccanacttgtttttaanacagtctaccaaacgtaaataacggaaacttacttaagcgtttaggtatcacgacaagaaacccgnggacagaccctaacctaaactgtacttaccaagttttccgtacgggctaacttacccggaccccggggttaacggtcccggggttaccctaggtaacccggtctttacgacggttcggagaccgggtcggtcgtaggctaagtcgtttcaactccgctaacgactacaacgtnaccgtgacgacgtacgaggtacgagttcggacgtagttaatttcttaagtctagagtacgtattagttaataacgtcttaccctacggtaccgtgaaccgaggtaacgagtaacaagtaacaacgtacgtgacgtcgagcctanacgttctcgttacaccgttatccccgttancctatcggtaaac

SEQ ID NO: 169339 - DNA, 703 bp, Homo sapiens
  misc_feature: GYAE6OF01B64GQ.37.11.A11.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatgacccagtctccagacctccctggctgtcgtctcgtgggcgagacgggcctaccatacaactgacaagtccagccagtacttgttttaanacacgactaccaaanaagtaacgaacttactagacgtttaggtatcagaccgaagaaaccgagggacacgtacctaacctaaactcgtccttactaacgtttacggtacgggtacctacggttacccggtaacccgggtccggttacccggggtccctacggtaccgtacgttcacgggtcggacggacgggtcgggtcgtagggaactaacggttactttacctacgttacccacctaaccctactaccgtaaccgtaacggtccccgtaggacccggtaggtaccgtaggtaacggtaggttggtacgggtacttaagtttactacgtgtacgagtactagttatacgtaactcgtcctacggtccgttacggacgtaacggtacgtaaggtacgaactaacgtaacgtagtcgtcgtacgacgtacctactacggtcctcgtttacctacctaccgttaccctaccgtactacttcgtaacg

SEQ ID NO: 169340 - DNA, 652 bp, Homo sapiens
  misc_feature: GYAE6OF01BFVD4.37.11.A11.1.454.CMB.1.raw
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgttttatacagctccaacaataagaactacttagcttggtatcagacaacgaaacgaggcagacctacctaaactgctactatttactggggctactcgtacccgggtaggtcccggggtcctgaccgtattcgagtcggcaggcgggtcgtggacagtacttacgactctaccacctatacaacacgcctgacgaggcgtaggaggagtggtacggtcgtaagttttattacgtaggtcacggtactaagttacttaataacttaccgtacccttaccggtacggtttaccgggaaccgtaaacgggggtaacccaaacggtcccgtaaggtaaaaccgttaaccgaaaaaccggtacgttaggtcggtaccgttacgacctaaccctagttaccttacgttccgtttactaccgtttaccccgtttaccccgtacccgtacttaccg

SEQ ID NO: 169341 - DNA, 630 bp, Homo sapiens
  misc_feature: GYAE6OF01D2OUH.37.11.A11.1.454.CMB.1.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (582)..(582): a, c, t, g, unknown or other
  misc_feature (582)..(582): n is a, c, g, or t
  modified_base (621)..(621): a, c, t, g, unknown or other
  misc_feature (621)..(621): n is a, c, g, or t
tcagtagtgtagatcacgaccggtgctcgatttagctacgactgcaggggcagcaagatggtgttgcagacccaggtcttcatttctctgttgctctggatctctggtgcctacggggacacgtgatgacccagtctccagactccctggctgtgtctcgtgggcgaggacgggcctccatcaactgacaagtccagccagacttgttttacacagcctaccaanaataagaactacttagcttaggtactcagacaagaaaccgnggcacgccctactaactgactactatttacgtggacagtccggtacccggggacggttcccgggtcctacggaccgtattcgaggtcgaccgaggcgggtacgtgggactagtacttccacttccacctaccataccaacacgtcctgaccgtaggctaggacggtgtggtcggtacgttaattttacgttacgtcgtcgagtactagttaatttaacgtaacttacccgtccgttacccggtacgttacgggaccgtaacgggaccgtaaaggtaggaaactacgaaaacgtctaggtcggctacgcctaacctnttcgttacgttcctttacgcctttacccgacccgtactnttcctaacg

SEQ ID NO: 169342 - DNA, 953 bp, Homo sapiens
  misc_feature: GYAE6OF01BN9WT.37.11.A11.1.454.CMB.1.raw
  modified_base (219)..(219): a, c, t, g, unknown or other
  misc_feature (219)..(219): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggacggccctccatcaacgtgacaacgtccagccaagtacttagttttanacagtcctaccaaacaataaacgaacttacttagtcttaggtactacaagacaacggaaaccgagggaccaacgtacccttaacctaaaacgtcgtaccttacgttaacgttttaccggtcgggacctaacgttaccccgggttaaacccccgggggtaccggtttcccccgggggttacccctacgggtaacccgtacgtttaccggaacgggttccgggaccgtaacggggtcccggggttaccggtaaccggggtaacgtacggtttaccttttacccaacctttcccgtaaccctaacccaacttaacccgaaaaccgtacggtccccttagggaccgtaacggggtacgttacgggtaagggtacgttcgggttacgggtacgtttaaacgttttattaccggtacggttacaacggttaccgttaaagtttaacctttaagtttaaacccgtttacccgtttaaccccggttacccgggtttaacccggttttacccggggaaacccccgggtaaaacggggttaacccggtaaaaggggtttaaaccgaaaacccgttaaaccggtaaaaccggttaacggttacgggttaaccgggtaccgttaaccgggtaaccctaaaccggttacctttccggtttaccgttttaccccgtttaaccttaaccccggttttacccccctttacccccggtaaccgtttaaccgtttacccggttaaaacccgg

SEQ ID NO: 169343 - DNA, 789 bp, Homo sapiens
  misc_feature: GYAE6OF01C74ZY.37.11.A11.1.454.CMB.1.raw
  modified_base (216)..(216): a, c, t, g, unknown or other
  misc_feature (216)..(216): n is a, c, g, or t
  modified_base (328)..(328): a, c, t, g, unknown or other
  misc_feature (328)..(328): n is a, c, g, or t
tcagtagtgtagatcacgaccggtgctcgatttagctacgactgcaggggcagcaagatggtgttgcacgacccaggtcttcatttctctgttgctctggatctctggtgccgtacggggacaccgtgactcgacccagtctccagacctccctggctgtgtctcgtgggcgaggcggcctcatacaactgacaagtccagccagtacttgtttanacagacctacaaacaaataacgtaacttacgttagtcgttaggtactcgaaggacaaacgaaaccgagggaccacgtacccttaacctaaacgtcgtactactatttaccgngggactacgtccggtaaccggggacggttcccgggtcctacggaccgtacttcgaggtggacacgggcggtcgtacggactagtacttcgactcgacacgtatcaactacgcgtcgacgtaggcgtacggaaggtacgttgggacgggttaacttttaacgttttaacgttaacgtcgtacgtaaacgtaacgttaaaggtttactttaacgttaaacgttcccccgtttaacccgttacccggggttaaccggtttacccggggaaacccggtaaacggggttaaccggaaaacggggttaacggtaaaaccctaaccgggaaaacggtttaccgttacggggtaacgtacccgttacgaacccgttaaacccgtttagtttaccgttaccgggtttaccctttacccggaccttttaccccccgtacccggtaaacccttggtacccgtttaaacccgg

SEQ ID NO: 169344 - DNA, 609 bp, Homo sapiens
  misc_feature: GYAE6OF01BWC3J.37.11.A11.1.454.CMB.1.raw
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (367)..(367): a, c, t, g, unknown or other
  misc_feature (367)..(367): n is a, c, g, or t
  modified_base (465)..(465): a, c, t, g, unknown or other
  misc_feature (465)..(465): n is a, c, g, or t
  modified_base (575)..(575): a, c, t, g, unknown or other
  misc_feature (575)..(575): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttanacagctaccaaacaataagaactacttagcttggatcagcaagaaaccngggacacgcctacctaactgctctatttaccgnggccagtccgtacccggggnggttcccggggtcctggaccgtagttcgaggtcggcaggcgggtctagggacaagtntttccgacgttcctaccaaccacttcgaaacacgtccctaggaccgaggtcttaggaggtagtggtgtacgtaattttacacttcggtacacggttanaaggttacttaagttaactccttaccgtaccggtaacgttccggacgaacggggtaccaaggttacgaactacgaagactggagtactaggctacgagttcttaccggtnttacctacttcccgtacccgactattccgtaacg

SEQ ID NO: 169345 - DNA, 734 bp, Homo sapiens
  misc_feature: GYAE6OF01DB97O.37.11.A11.1.454.CMB.1.raw
  modified_base (211)..(211): a, c, t, g, unknown or other
  misc_feature (211)..(211): n is a, c, g, or t
  modified_base (314)..(314): a, c, t, g, unknown or other
  misc_feature (314)..(314): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactcccgtggctgtgtctcgtgggcgagaggcctcatcaactgacaagtccagccagtacttgttttanacagcctaccaaacaataagtaactacttagcttaggtatcgaacgacgaacggaaaccgagggcctacgtaccctacctaaactcgtctactagttttacgngggacctacgttaccggtacccggggtacggttcccggggtccctaggtacccgtattcgacggtcggtcgacgggtcgggttaccgtagggtaacctaaggtactttaccgaccttccgtacctaacccgtactacccgaaaccgtacggtccctaggcccgtaggtaccgtagggtaggttaggtcggttacgggttacgtttaagttttacttacggttacgtacgtaggttaccgttaagtttaactttaaccgtaacgttaccttacccggttacggtacccgtttacgggaacccgtaaacggggtacctaaagggttacgaaacgtacgaaaccgtacgtcggtcgtacgtccgaaccgtattacgttccgtacgtcctttaccgtccttccctaccccacttcgtcttaacg

SEQ ID NO: 169346 - DNA, 707 bp, Homo sapiens
  misc_feature: GYAE6OF01A16BT.37.11.A11.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttaanacagctaccaaacaataaagaactacttagcttaggtatcgagacaagaaaccgagggcacgtccctacctaaactgctctatttacgngggcacgtccgtacccggggtacggtcccggggtccctaggaccgtattcgaggtcggcgacggcgggtcgtgggacagtactttccactcctacaacctataccaacgacgtccgtgacgaggcgtggaggtacgtcgggtcggtacgttaattttacttacgtggtacgaagtcgtaagttaactttaactaaacgttcccgttacccgttaccggttaaccgttacccgggaaccggtaaacggggtaacccgtaaaggggttaaccgtaaaacgtaacccgaaaacggtacgtacgggtacggtacccgttacggacccttaacctacggttccttaccggtttacccttaccggtaaccctttcccccgttaacccccacccgttaaacttcccggttaaacg

SEQ ID NO: 169347 - DNA, 745 bp, Homo sapiens
  misc_feature: GYAE6OF01DM3AD.37.11.A11.1.454.CMB.1.raw
  modified_base (730)..(730): a, c, t, g, unknown or other
  misc_feature (730)..(730): n is a, c, g, or t
tcagtagtgtagatcacgaccggtgctcgatttagctacgactgcaggggcagcaagatggtgttgcagacccaggtcttcatttctctgttgctctggatctctggtgccgtacggggacacgtgatgacccagtctccagacctccctggctgtgtctcgtgggcgagacggcctcatcaactgaccaacgtccacgccgagtacttgttttaacacgacgacctacaaactaaataacgtaaacttacgttagtcgtttaggtactacgagacgaacgaaaccggacggactaacgacccttaactaaacgtcgtactactacgtttacgcggactacgtaccgtaccgggacggtcccgggtacctacgacgtatacgaggtcgacgacggtcggtacgtacggactagttacttacgacgtctaccgaacctagtaccaacgtaccggtctacgacggtaacgtccgtagggtaaggtcggtaggttacgggttaactttagttttaacgtacggtacgtacggtaacgtagttaaacgttttacttaaccgttaacttacccgttacccggtacccggtttaccgggttaaccggaaccgggtaaaccgggtaaacggtaaacggtaacgggtaaaccttaaccggaaacggtaccggtttgaccggttacaccgtaccgtatacgtttcgtcctttacgttacacccgtttccaaccccgttntacggtacttaacgg

SEQ ID NO: 169348 - DNA, 557 bp, Homo sapiens
  misc_feature: GYAE6OF01BU4W5.37.11.A11.1.454.CMB.1.raw
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagacgggcctccatcaactgcaagtccagccagacttgttttanacagctaccaacaaataagaactacttagcttggtatcagcagaaaccgagggcagcctactaaactgctctatttacgngggcagtccgtacccgggagtccggggcctgaccgtattcgagtggcaggcggtnggacagtnttcactcnctaccatacacgcgcctgacgnggctgaggtatggtcgtgttatttagttacgngtcagtctaagttattaactaacttcctccgtaccgtcgttcgggacccgtaagggtaccaagggttacgaaataccgaaagtacgtggtacgctacgaccactagttcctgttactccacttccgtccccatcgtcgtaac

SEQ ID NO: 169349 - DNA, 646 bp, Homo sapiens
  misc_feature: GYAE6OF01D5A13.37.11.A11.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagcctaccaaacaataagaactacttagcttggtatcagcaagaaaccgagggcacgccctacctaaactnctcatttacngggcatccgtacccggggagtcccgggtccctgaccgtattcagtcggcaggcgggtcgtgggacagtatttccacttcctacaacctatccaaacgacgtcctgacagggctaggaggtagttggtagggtacgttaatttacgttacgtgtacgagtactaagtttattaataacttaccgttccccgtaccggtaccgttaccgggacccgtaaaggggtaacccgtaaagggttaacggaaactaccgaaaaccggtaacgtgggtacggacctacggaccctaaccgtattccgttcgttacctttaccgtaccttaccccgttacccccgacctacgttaccgtaacg

SEQ ID NO: 169350 - DNA, 858 bp, Homo sapiens
  misc_feature: GYAE6OF01BEPBD.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtggcgagacggcctccatcaactgactaacgtccagccaagtactttgttttaacacagtacctaccaaacgtaaataaacgtaacttacttagtcttggtaactcgaagaccgaaacggaaaccgtacgggactacgaccctacctaaactcgtacctactacgtttacgtcggactacgttacccggtaacccggggtacggttcccggggtaccctacggaaccgttagttaccgacggtcggacggtacggggtccgggtaccgtacgggtaactacgttacgtttacccgaccgtttacctaacccctaacctaacgtaacccgtaaaccgtaccggtccgtacggtaccggtaacggtcgttaacgggtaacgggtacgttacgggttacggggtaaccttttaaagttttaaccgttacggttacgttaaccgtaaggttaacgttaaattttaacgttaaacttaaaccgtttaccccgttacccggttaaccggtaaccggtttacccgggaaacccgggttaacggggtaaacccgtaaagggttaaacggtaaacctaacggaaaaaccggttcgtagggttaccgtaccggtaacccgtaccgtaaccttacggttaccttcccgtttacccgttaacttacccgtttaccccttaacccctcgttaaaccgttcgttaaacccg

SEQ ID NO: 169351 - DNA, 632 bp, Homo sapiens
  misc_feature: GYAE6OF01CWPNA.37.11.A11.1.454.CMB.1.raw
  modified_base (215)..(215): a, c, t, g, unknown or other
  misc_feature (215)..(215): n is a, c, g, or t
  modified_base (308)..(308): a, c, t, g, unknown or other
  misc_feature (308)..(308): n is a, c, g, or t
  modified_base (411)..(411): a, c, t, g, unknown or other
  misc_feature (411)..(411): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctcccgtggctgtgtctcgtggggcgaggcgggcctccatccaactgcaagtccagccagtacttgtttanacagcctaccaacaaataacgtaacttacttagcttaggtatacagacaagaaaccgagggccacgtccctacctaactcgactctattacgnggactacgtccgtaccgggcggtcccgggtcctggaccgtattcgaggtcggacgacgggtcggtcgtgggactaagttcttccactctaccactacacaacncgacctggacgagggctaggaggtgtcggtacgtacgttatttactacgttcgtacagtactaagtttaacttaacttaactaccgtttacccgtacggtaccgttaccgggaacgaacgggtaacgaaggtaacgaaactcgaaacgtacgtggacgctacgactacctacttcgttcgttactaccttaccgttcccttacccggacctcgttctaacg

SEQ ID NO: 169352 - DNA, 731 bp, Homo sapiens
  misc_feature: GYAE6OF01BK9FF.37.11.A11.1.454.CMB.1.raw
  modified_base (212)..(212): a, c, t, g, unknown or other
  misc_feature (212)..(212): n is a, c, g, or t
tcagtagtgtagatcacgaccggtgctcgatttagctacgactgcgaggggcagcaagatggtgttgcagacccaggtcttcatttctctgttgctctggatctctggtgccgtacggggacaccgtgatgacccagtctccagacctccctggctgtgtctcgtgggcgagagggcctccatcaactgcaagtccagccagacttgtttanacagctacaacaataagaactacgttagcttaggatcgaagtcaagaaaccgagggacacgtccttacctaaactcgaccgtactatttaccgtgggacctacgtccgtacccgggagtcccggggtcctacgaccgtagtttcgaaggtcggtacgacggtcgggtaccgttacggggaactaaggtacgtttaccaacgttcctaccgaaccaacgttaccgaaaccgacgtaccttacggcgtaacggtccgttagggaactacgttggtacgtaacgtttatttacgtactgacgtacgagtagttaatttacaaacgtttcctaccgttaacccggtcgttacccgggaacgaaaccggggtaaccgtaaagggttaacgaaacgttacccgtaaaaagtaccggttaaggaccggttaccctacgaaccgttaacccgtaaggttcccgttacggttaccctttacgtaaccccgtttccgtaaccccgttaccgtaacgttccgttaaaccg

SEQ ID NO: 169353 - DNA, 610 bp, Homo sapiens
  misc_feature: GYAE6OF01CL3FL.37.11.A11.1.454.CMB.1.raw
  modified_base (208)..(208): a, c, t, g, unknown or other
  misc_feature (208)..(208): n is a, c, g, or t
  modified_base (290)..(290): a, c, t, g, unknown or other
  misc_feature (290)..(290): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctcatcaactgcaagtccagccagacttgttttanacagctaccaacaataaagaacttacttagcttggtatcagacaagaaaccgagggcagcctactaaactgactcatttacngggctaactccgtacccgggacggtcccgggtcctgaccgtattcgagtggcnggcggtctcggatagtattcactctcactatcaacncgcctgacctgggctaggaggtagtggtaggacgttatttacttacgtcggtacagtactaagttatttaacgttaaacttcccgttaccgttaccggtaaccgtttacccgggaccgtaaacggggtaacccgtaagggttaacgaaacgtacgaaaacgtacgtagtacggactgacctaacctgttctacgttacttcctacttcccgttacccgctacgtcttaacg

SEQ ID NO: 169354 - DNA, 739 bp, Homo sapiens
  misc_feature: GYAE6OF01A2U5O.37.11.A11.1.454.CMB.1.raw
  modified_base (300)..(300): a, c, t, g, unknown or other
  misc_feature (300)..(300): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaaacaataagaacttacttagcttaggtatcagcaacgaaaccgagggacacgccctacctaaactgcctactacgtttacgngggctacgtccggtacccgggcggtcccggggtccctggacccgtattcgaggtcggcgaggtccgggtcgtacgggactaggtactttccgactcctaccgaacctatacccaacgacggcccttggacgacgggtccgtagggaacggtgttacgggtcgggtacgtttaaacgttttaacgttacgtgtacgaacggtaccgttaaagtttaacttaacttaaacctttacccgttaccccgttacccggtaccggtttaacccgggaacccggtaaacggggtaaacccgtaaagggttaaccggaaaaccgtaaccgtaaaaccggtacgttacgggtacggtaccgtaccggacctaaccgttacgttccgttacgttaccctttaccgtaccctttaccccgttaccccgtcccttaagtttcccgtaaacg

SEQ ID NO: 169355 - DNA, 613 bp, Homo sapiens
  misc_feature: GYAE6OF01AK50N.37.11.A11.1.454.CMB.1.raw
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctatgggcgagacgggcctccatcaactgcaagtccagccagtactgttttanacagcctaccaacaataagaacttactagcttggtatcagcaagaaaccngggcagcctactaactgctctattacgtgggcatcgtacccgggagtcccggggtccctgaccgtattcgaggtcggcgaggcgggttcgtagggacagtactttcactcctacacctatcaacacgcctgcgtaggctagaggtatggtcggtagtaattttacttactcggtacgagtctaagttattaacgttaactaccgtcccgtaccggtaccggttacggaccggaaacgggtaccgtaaagggttaagtaaacgtacgaaaacgtacgtggtacggactcgaccacgtactccgttacgttacttaccgtacttacccgttaccccgaacttcgttcgttaaccg

SEQ ID NO: 169356 - DNA, 874 bp, Homo sapiens
  misc_feature: GYAE6OF01DALWV.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactcccgtggctgtgtctcgtgggcgaggacgggcctcatcaactcgacaacgtccagccagtacttagttttataccgacgtcctaaccaaactaaactaaacgtaaccttacttagtacgttggtactcgagtaccaacgaaaccgaagggccctaacggtaccccttaaccgttaaacgtcgtaccttacttaacgttttaccggcgggtacctacgttaccccgggtaccccgggggttaccgggttaccccgggggttcccctagggtaccccgttaatttccggaacgggtcgggaccggttaacggggtccggggtttaccgacggggtaaacctacggttaacctttaccctaccgtttacctaacccaaccttaactacccgtaaaaccgtaccggtcccggtaccggaccggttacggggtacgttaacggggtaagggtacggtttacgggtcgggttaaccttttaagtttttacttaacggttccggtacgtaacggtaacctttaaggtttaatttaacctttaccggttaaaccccgtttccggtaacccggggttaaccgttccggggaacccggaaacggggtacccggtaaaggttaaccggtaaaacctacgtaaacggacgtttgggaccgtcgtacgtacccggtaactcggtttcctccgttactttacccggttaccctacccttcccgtaacgtgtttcggtaaccg

SEQ ID NO: 169357 - DNA, 584 bp, Homo sapiens
  misc_feature: GYAE6OF01EEL27.37.11.A11.1.454.CMB.1.raw
  modified_base (209)..(209): a, c, t, g, unknown or other
  misc_feature (209)..(209): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtactgttttanacagctaccaaacaataacgaactacttagcttggtatcagcaagaaccagggcagcctactaaactgctcatttacgtggacattccgtaacccgggagtcccggggtccctgaccgtattcgagtcggacaggcggtctggacagtattcactctacaccatacaacagcctgacaggctgacggntgtcggtactaatttactntgtcagtatagttaattaactaacttaccttaccgtaccgtacgttccgacgtaaaggggtaccaagggttacgaaactacgaaacgtaacgtggtacgactacgacctaactacgttccgttacgttccttaccgtaccttacccgttccccgactacgtcgtaacg

SEQ ID NO: 169358 - DNA, 577 bp, Homo sapiens
  misc_feature: GYAE6OF01ESNWM.37.11.A11.1.454.CMB.1.raw
  modified_base (291)..(291): a, c, t, g, unknown or other
  misc_feature (291)..(291): n is a, c, g, or t
  modified_base (538)..(538): a, c, t, g, unknown or other
  misc_feature (538)..(538): n is a, c, g, or t
  modified_base (567)..(567): a, c, t, g, unknown or other
  misc_feature (567)..(567): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttggtatcagcaagaaaccagggcagccctacctaaactgctctaatttacgngggccacgttccgtaccccggggacggttcccggggtccctcggaccgattcgaggtcggcaggtcgtggtacgtggggacagtactttcacttctcaccatacaacacgtcctgcgaggctaggaggtagtggtggtacgtaatttatacgtgtacagtctaagttattatactctccgtccgacgttcggaccgaagggacctaaggtagaaactacgaaacgtacttggcgacgtcgacacctnttcgtcgttccttacgacttcccgtcccnctagttaccg

SEQ ID NO: 169359 - DNA, 799 bp, Homo sapiens
  misc_feature: GYAE6OF01BVPWJ.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgccgtacggggacaccgtgatcgacccagtctccagacctccctggctgtgtctcgtgggcgaggacgggcctccatcaactgacaacgtccgagccagactttagtttacacgagcctaaccaaacaaataaacgtaacttaacgttagtctttaggtactacgaagacaaacggaaaccgacgggacaccggtacctaacctaaacgtcgtaccttactagtttacgtcgggacctacggttacccggtaacccggggtcggtccccggggtacctacggaccgtacgttcggacgggtcggaccggtacgggtccggggttacgtacggggaacctacgttaacgtttacccacttaccctaaccgtaacctaacgtacccgaaacgtccggtaccgtaggacccggtaggtaccgtaagggttacgggtacgtttcggggtacggtttaaccggtttaatttttacggtaaccggttacggttacgtaacggttacgttaaagttttaaacgtttaaacttaaacccgttccgttaccccggtaccggggttaaacggtacccggaacggtaaacgggtaaccggtaaagggtaaacggtactaacggtaaaccgtagtcggtacgtacgaccgtactacgtacgttcgtccgttactccgtacttcccgtaccctatcttcgtaacg

SEQ ID NO: 169360 - DNA, 661 bp, Homo sapiens
  misc_feature: GYAE6OF01AUSZ9.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactcccgtggctgtgtctcgtgggcgagacgggcctaccatacaactgacaacgtccagaccagtacttgttttaactacacgactaccaaactaaataaacgaacttacttagtacttaggtactcgaagacaaacgaaaccgaggacacgtaccctactaactgctactactttacgcggactacgtccggtaccgggtacggttccccgggtcctacggaccgtacgttcgaaggtcggacgacgggtcgggtacgtacggactagttacttccgtactccacgaacctataaccaaccgacgtccgtgaccgtaggctaggacgtagtcggtaggtacttaattacgtcgtacgcgtaatacgtaagttaattacgtaaccttacctcccgggttacgtacggtaccgaaccggtaacgtaacggtaagtaacgaactaccgaagttcgtacggtcacgtcgacctactacttcgacgttcttacctaccttcctacccgacttcgtcgttaac

SEQ ID NO: 169361 - DNA, 769 bp, Homo sapiens
  misc_feature: GYAE6OF01APPN6.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggccctccatcaactgacaagtccagccagtacttgttttatacacgctaccaaacaaataagaacttacttagtctttacggtatacacgacgaacgaaaccgacgggaccacgaccctacctaaactcgactactactttacgtggtcctacgtaccggtacccgggacggttcccggggtccctcgaaccgtattcgaggtcggcgcggtcgggtcgtaggactagtactttcctactcctacaacctactaccgaacacgaccgtcgaccgtagggtcctaggaacggtacgttgggtacgggtactttaattttacgttacgttagtactaacggtactttaaagtttaaactttaactaaacccgttttacccgtccccggtttaaccgggttacccggttaccggggaaacccggtaaaaccggggtaacccgttaaagggggttaaacggtaaaacgtaacccggtaaaacgtaaccggttagggtaccgggtaccttacgggtaccctaaccctttagttccgtttacccgttaccttttaccctaaccgtttccccttacccccgtacttaacccgtttcgtaaaccg

SEQ ID NO: 169362 - DNA, 647 bp, Homo sapiens
  misc_feature: GYAE6OF01DFECH.37.11.A11.1.454.CMB.1.raw
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
  modified_base (637)..(637): a, c, t, g, unknown or other
  misc_feature (637)..(637): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggacgggcctcatcaactgacaacgtccagccagtacttgttttacacagtcctacaaactaataaagaacttacgttagtcgttagtatacagacaaacgaaccgagggcacgtcctaacctaacgtgactactaacgtttacgcgggtactacgtaccggtacccggggtcggtcccgggtaccctgaccgtagttcgaggtcgacggacggtcgggtcgtacgggactaaggtactttaccaccgtacctaccgaacctaacgtaccgtaaacgaccggtcctacgtacgacgggtacgtaggacgggtagtcggtacggttacttaagttttactaacgtgtacgtagtaaccgtagttattaactaaccttcgtaccgtcggtacgtacggacggtaacgacgaagtacgaatacaacgatggcgtcacgactancttcgtntcttacgtccttacctacccntactcgtaac

SEQ ID NO: 169363 - DNA, 718 bp, Homo sapiens
  misc_feature: GYAE6OF01BJTY5.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggcctcatcaactgacaagtccagccagtacttgttttacacagcctaccaaacaataacgaacttacgttagtcttaggtatcagacaacggaaccgagggcagtccctaactaactgactctactttacgtgggtcacgttccggtaccgggtacggtccggggtccctaggaccgtattcgagtcggacgtagggcgggtacgtcgggaactagttactttaccgacctcgtaccctaactacgtaacaaaccgtcggcccttacgacggtacgggtacgtacgggtaggtaggtcgggttacgggtacgtttaagttttacgtttaacgtacgttacgaacgtacgttaagtttaacgttaattaaaccgtttacccttacccggttaccggtaccggtttaccggaaccggtaacgggtaaccggtaagggttaacgaaacgtaccgtaaaccgtaacgtcggttacggtcgttacgacctacttaacgttccgttacgttccttacctacttcccggttacccacgttcttaccgtaacg

SEQ ID NO: 169364 - DNA, 736 bp, Homo sapiens
  misc_feature: GYAE6OF01BLID4.37.11.A11.1.454.CMB.1.raw
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagcctaccaaacaataaacgaactacttagctttaggtatcagcaagaaaccgngggacacgcctacctaaactgcctctatttacgngggcagtccgtacccgggacggtcccggggtccctgaccgtattcgagtggacgaggcgggttcgagggacaggtactttccaaccgttcctaccgaacctaacgtaccaaacgacggcccgtagccgagggtccgttagggacggtaagtttggtacgggttacgtttaattttaacgttacgtacggttacaacggtacgttaaaggtttaatttaacgtttaaaccttacccgtttaccccgttacccgggttaaccgggtttacccgggaacccggtaaacgggggtaaacccgttaaacggggttacggaaaacttaaccggaaaaccgtaacggttggtacgggtaacctacggtaacccaccttacgtcccttacgttacccgttactacccgtttccccgttacccgtacccttacgttccgttaaacg

SEQ ID NO: 169365 - DNA, 695 bp, Homo sapiens
  misc_feature: GYAE6OF01BV4WN.37.11.A11.1.454.CMB.1.raw
  modified_base (289)..(289): a, c, t, g, unknown or other
  misc_feature (289)..(289): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcacgcctacctaaactgactctatttacgngggcacgtccgtacccgggacggtccggggtccctggaccgtattccgaggtcggcgacggtcgggtcgtagggactacggtactttccgactccgtacaaccctataccaaaccacgtcctacggaccgtagggtcctagggaacggtacttgggttacggtacgtttaacttttacgttaacgttcgtaccgaggtacctaagttttaacttaacgttaaacttacccgtcccgttaccgggttaacccgtttaccgggacccggtaaaacggggtaccctaaagggtacgtaaacgtaccgaaaaccgtaacgtggtaccggacttccgaccgtaacctacgttccgttacgttccttacctaaccgtttccccttaccccggaccttaagttccgtaaaccg

SEQ ID NO: 169366 - DNA, 728 bp, Homo sapiens
  misc_feature: GYAE6OF01CQI58.37.11.A11.1.454.CMB.1.raw
  modified_base (216)..(216): a, c, t, g, unknown or other
  misc_feature (216)..(216): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagacgggcctccatcaaactgacaacgtccagccagtacttgtttaanacagctaccaaataataagaacttatagtcttaggtatcagacaagaaccgagggccacgtaccctaacctaaacncgtacctactaattttaccgngggtactacgttacccggtacccgggggtacggttccccggggtaccctaggaacccgtagttaccgagggtcggacgacgggtcgggtcgtagggactagtacttcactcgtaccacgtactaccaacgtacgcgtacggaccgtagggccgttaggtaagggtcttagggtacgggtactttaaacgttttacgtacgtcgtacgtagtaacgttaagttaactttaagtaaccttcccgtaccgttaccggtaaccgttaccgggaaccgtaaacgggtaccgtaaaagggtacgtaaaactaccggaaaaacgtggtggtacccggattaccggaccctaacgttacgtttccgtacgtttacccttagtaacccccgtttccctaacccgaaccttagtccgttaaaccg

SEQ ID NO: 169367 - DNA, 865 bp, Homo sapiens
  misc_feature: GYAE6OF01AOKX3.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccctggctgtatctcgtgggcgagagggcctccatcaactgcaacgtccagccagtacttgttttaatacagcctaccaaacaataacgaaccttacttagcttggtatacgagacaacgaaaccgagggccacgccctacctaaactgacctactacgtttaccgtcgggactacgtacccggtaacccggggtccggttcccggggggttccctacgggtaacccgtacgtttccggaacgggttcggaccgtacggggccgggttacggtacggggtaacctacggttactttaccgtaccgttcccgtccaaacccgtatacccgaaaccgtaccgtcccgtaggtaccgaacgggtcgtacgggtaagggtacggttacgggtacgggttaacgttaagttttaacgtttaccggttacggtacgtacggtaaccgttaaaggtttaactttaacgttaaaccgtttacccgtttaccccgtttacccgggtaacggtttacccgggtaaccggtaaacggggtaacccggttaaacggggttaaacggtaaaaccgttaaccggtaaaaaccgggttaactacgggttacgggtaaccgttacggtaacccgtaacccgttaaggtttccctttaccgggtttaaccctttacccgttaacccgtttccccgtttaaccccgaccccgtttacgttaaccggttaaacccg

SEQ ID NO: 169368 - DNA, 843 bp, Homo sapiens
  misc_feature: GYAE6OF01AUJ53.37.11.A11.1.454.CMB.1.raw
  modified_base (216)..(216): a, c, t, g, unknown or other
  misc_feature (216)..(216): n is a, c, g, or t
tcagtagtgtagatcacgaccggtgctcgatttagctacgactgcaggggcagcaagatggtgttgcagacccaggtcttcatttctctgttgctctggatctcgtggtgccgtacggggacaccgtgatcgacccagtctccagactcctggctgtgtctcgtgggcgagacggcctccatcaactgacaacgtccagccagtaccttgttttanacagcctaccaactaataacgaacttacttagtcgttaggtactaccgaagaccgaacgaaaaccgaggggccacggtcccttaaccttaaaacgtcggtaccttaccgtaattttaccggtagggggtacctaacgttacccggtaaccccgggggtacgggttccccgggggttaccctacggaaccccggtagtttccggaaggttcggaccggacgggtccggggttacgtacggggtaacctacggttactttacccgacctttacccgtaccgaacctaacgtaccaaaccgtacggcccttggaccgacgggtcgtagggtaggtagttacgggtagggttaccgtttaagttttaacgttaccggttacggtacgtaacggtacttaaacgttttaagtttaaccgttaaccgtttacccgttaccccggttaaccccgggttaacgggtttacccggggaacccggtaaaccgggggtaaccgtaaggggtaacgaaaaccttaccgggaaaacgtacggtggtaccggggtaccctacggacccgtaccgtagtttcccggttacgttccttaccgtacccgtttcccgtaaccccgaccttaacgttcgtaaccgg

SEQ ID NO: 169369 - DNA, 825 bp, Homo sapiens
  misc_feature: GYAE6OF01BCCUR.37.11.A11.1.454.CMB.1.raw
  modified_base (216)..(216): a, c, t, g, unknown or other
  misc_feature (216)..(216): n is a, c, g, or t
  modified_base (326)..(326): a, c, t, g, unknown or other
  misc_feature (326)..(326): n is a, c, g, or t
tcagtagtgtagatcacgaccggtgctcgatttagctacgactgcaggggcagcaagatggtgttgcagacccaggtcttcatttctctgttgctctggatctctggtgcctacggggaccaccgtgatgacccagtctccagactccctggctgtgtctcgtggggcgagagggccctccactacaactgcaacgtccagccagacttgttttanacagcctaccaaacaataaacgtaacttacgttagtcgttaggtatacgacgacgaacggaaaaccgacgggacacgtacccttacctaaactcgacctactatttacgnggacctacgttccggtaccccggggtacggtcccgggtccctacggaacccgtattcgacggtggacgacggtcggtcgtacggacgtacgtacgtttccaccgttcctaccgacctactaccgaaacgccgtccgtacgacgacgggtaccgtagggtaaacggtgttcgggttacggttacgtttaaacgtttttacggttacgttcggtaacccgtaaggttaaccgttaaacgtttaacgttttaaactaaccgttttaaccccgttcccccggtacccggtaacccgggttttaacccgggaaacccgggtaaaacgggggtaacccggttaaaaggggtaaccgttaaaaccgtaaacccgtaaacgggtaaccgttggggtaaccgtaaccggtaccggtaccctaacgttacccgtttcgttaccggtttaacctttcccggttaacccttcccccgttaaccccggtaccttaccggttacttaaaccgg

SEQ ID NO: 169370 - DNA, 663 bp, Homo sapiens
  misc_feature: GYAE6OF01AJGTF.37.11.A11.1.454.CMB.1.raw
  modified_base (213)..(213): a, c, t, g, unknown or other
  misc_feature (213)..(213): n is a, c, g, or t
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagacgggcctccatcaactgcaagtccagccagtacttgttttanacagcctaccaacaaataagaacttacttagtcttagtatacagacaacgaaaccgagggcacgccctacctaaactcgactctatttacgngggctacgtccgtacccggggtacggtcccggggtccctggaccgtattcgaggtcggacgtacggcgggtcgtaggactagtacttacactctaccacactacaacncgccgtgcgaggctaggagtgtcggtacggtacgttagtttacttacgtggtactaggtactaagtttaattaacgtaacttccgtacccgtaccggtacggttaccggaccggtaaacgggtaaccgtaaagggtaacgtaaacgtaccgaaaccgtacgtagggtacgccgtaccgtacctacccgtagttccttcgttaccttacccgtaccttaccccgttaccccgtcttaacgttcgtaaaccg

SEQ ID NO: 169371 - DNA, 729 bp, Homo sapiens
  misc_feature: GYAE6OF01CI2P7.37.11.A11.1.454.CMB.1.raw
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (256)..(256): a, c, t, g, unknown or other
  misc_feature (256)..(256): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagaggccctcatcaactgcaagtccagccagtacttgtttanacngcctaccaaactaataaacgaacttacgttagctttaggttanacgagacgaacgaaaccgaggcacgaccctacctaaactcgcttactacgttttacgcgggtacctacggtcccgtacccggggtcggtcccggggtccctacgaccgtattcgagtcggacgtagggtcgggtcgtacggactagtacttccgactcctacaactactacaactgcctcgacgcggtcgtagggaggtcgtaggtacgggttacttaacgtttttacgtaacgttgtacggtacgttacttaaaggttttaaacttacttaaaccgtttccttacccgtaacccgggtttacggtaccgggtaacccgtaaaccggggtaaccgggtaaggttaacgaaacgttaaccgaaaaccgggtacgttacgtacgggtaccgttaaccgtacccgtaccttaggtttcccgttatttacccgtttccacgttttcccccgaccttaccgttaacgttgtaacccgg

SEQ ID NO: 169372 - DNA, 636 bp, Homo sapiens
  misc_feature: GYAE6OF01DX30A.37.11.A11.1.454.CMB.1.raw
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgacaagtccagccagtacttgttttaanacagcctaccaacaataagaactacttagcttggtatcagacaagaaaccgagggacacgccctacctaaactgactctatttacgnggcagtccgtacccggggagtcccgggtccctgaccgtattcgagtggacgaggcggtcgtggactagtacttcactctaccactagtacaacncgcctgacgngctggaggtagtcggtggtacttatttgttacgtgtactagtacctaagtttaacgttaattaactacccgttcccttaccggtacggttacccggaaccgaaacgggtaccgaaagggttacgaaacttaccggaaaacgtacgttagtcgggtacctacggaccctaactagttccttcggttacctttaccgtactttaccccgttaccccgacttacgttccgtaaccg

SEQ ID NO: 169373 - DNA, 725 bp, Homo sapiens
  misc_feature: GYAE6OF01E003H.37.11.A11.1.454.CMB.1.raw
  modified_base (272)..(272): a, c, t, g, unknown or other
  misc_feature (272)..(272): n is a, c, g, or t
  modified_base (310)..(310): a, c, t, g, unknown or other
  misc_feature (310)..(310): n is a, c, g, or t
  modified_base (335)..(335): a, c, t, g, unknown or other
  misc_feature (335)..(335): n is a, c, g, or t
  modified_base (404)..(404): a, c, t, g, unknown or other
  misc_feature (404)..(404): n is a, c, g, or t
  modified_base (580)..(580): a, c, t, g, unknown or other
  misc_feature (580)..(580): n is a, c, g, or t
  modified_base (603)..(604): a, c, t, g, unknown or other
  misc_feature (603)..(604): n is a, c, g, or t
  modified_base (690)..(690): a, c, t, g, unknown or other
  misc_feature (690)..(690): n is a, c, g, or t
  modified_base (716)..(716): a, c, t, g, unknown or other
  misc_feature (716)..(716): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctccacgacctcccgtggtcgtggtcgtcgtcgtgggcggacgcggcctccatcaactgcaacgtccacgacctagtacttacgtttaactacacgacctaaccaactaaactaacgtaacttactttacggnttaggtactacgacgaccgaacgaaaccgacgggaccncgtacctacctaacgtcgtactacnaacgtttaccgtactttcttacgtacccggtaccggtaccgggtacccggttccgtaccgtacgtacgntacgtacggtacggtacggtacggtacgggtacggttacggtaacgtaacgttaacgttacccgttaacccgttacccgtaacccgtaacccgtaaccctaaaccgtaacccgtaaccggtacccggtaccggtaccggtacgggtacgggttaacgggtaacggttaacggtttncggaacgtttaacggtttaacgnnttttacgtttacgttacgtacgtacgtaacgtaacgttaacttaactaacgtacctaccgtaccgtacgtacggacgacgacgagnaacacaacgacgtgtgcgtcgcaccnctcgtcgtc

SEQ ID NO: 169374 - DNA, 793 bp, Homo sapiens
  misc_feature: GYAE6OF01BJF5D.37.11.A11.1.454.CMB.1.raw
  modified_base (209)..(209): a, c, t, g, unknown or other
  misc_feature (209)..(209): n is a, c, g, or t
  modified_base (313)..(313): a, c, t, g, unknown or other
  misc_feature (313)..(313): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctgtgggcgagaggcctcatcaactgacaagtccagccagtacttgttttanacagcctaccaaacaaataacgaacttacttagtcgttaggtatcaagacaaacggaaaccgagggccacgaccctaacctaaactgaccttactactttacgngggactacgttccggtacccggggacggttcccggggtccctaggaccgtattcgaggtcggcgtacgggtccggtacgtggactagtacttcactctaccaactactaccgaacgtaccgtcctacggtacgagggtaccgtaggtaacgggtagttcgggtacgggtacgtttaaagtttttacgtacgttacggaacgtacggttaacgttaaacgttttaaatttaaccgttaaacgtttaccccgtacccgtttacccgggttaacccggttaccggggaacccggtaaaacggggtaacccggtttaaaagggttacggtaaaaaccttacccggtaaaaaaccggtccggttaggtaccgggtaccgtaccggaacccgttaacccgttagttcccgtttaacgtttccccgtttaaccgtacccgttttaccccgttaacccccggtcttaaaccgtttccgttaaaaccgg

SEQ ID NO: 169375 - DNA, 694 bp, Homo sapiens
  misc_feature: GYAE6OF01BX7RA.37.11.A11.1.454.CMB.1.raw
  modified_base (437)..(437): a, c, t, g, unknown or other
  misc_feature (437)..(437): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagcctaccaaacaataaagaacttacttagcttggtatcagcaagaaaccgagggcacgccctacctaaactcgctactatttacgcgggactacgtccggtaccccggggtacggttcccggggtccctcggtaccgtattcgaggtcggcgagggtcgggtcgtgggactagtactttcacttctaccaacctataccaacacgcctcgcgaggcgtaggaggntgggtcggtacgttaatttacgttacgtggtaccgagtacgtaagtttaatttaacttaactttacccgttacccgttccggttaaccgggttaccgggaaccgtaaacgggggtaacccgtaaaggggtaacgtaaacgtacccgaaaacggtaacgttcgggtacggtaccttacggaccctaaccgtacgtttccgttacgttacctttaccgtaccctttaccccgtttaccccgacttacgttccgtaaacg

SEQ ID NO: 169376 - DNA, 748 bp, Homo sapiens
  misc_feature: GYAE6OF01COZG1.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttatacagcctaccaaactaataaagaacttacttagcttggtactacagacaagaaaccgagggaccagaccctaacctaaactcgcttactattacgtcgggctacgtccggtacccggggacggttcccggggtccctagaccgtacttacgacggtcgacgacgggtcggtacgtgggaactagtactttaccgaaccttctaccacctaacacccgtaacgacgtcctcggtacgagggaccgtaggaaggtacttcgggtacggtacgtttaactttaacgttaacgttgtacgtaaggtaccttaaagtttaactttaacttaaaccgttaccctttaacccgggttacccgggttaaccggtttaccggggaacccggtaaacggggtaaccggttaaaggggttaacgtaaaaccgttaccggaaaaacgtacgtgggtaaccggtcgaccggtaacctacgtaactttccgtacgtttacccttacccgtacttaacccccggttcccaaaccgtttacttccggtaaaccg

SEQ ID NO: 169377 - DNA, 661 bp, Homo sapiens
  misc_feature: GYAE6OF01ETJ38.37.11.A11.1.454.CMB.1.raw
  modified_base (159)..(159): a, c, t, g, unknown or other
  misc_feature (159)..(159): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
  modified_base (598)..(598): a, c, t, g, unknown or other
  misc_feature (598)..(598): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatgaccagtctccagactcctggctgtgtctcngggcgagagggcctccgatcaactgcaagtccagccagtactgttttaagtacagctccaaacaataagaactactagtcttggatacagcagaaacnggcagctcaangctcattacgnggcatcgtaccgggntccgggccngaccatcagtgcagcggtctggacagactttcgactctacgacctagtaccaaacncgacctgacgaaggtcctaggaacggtactggttacgggaccgtaagttttactaaccgttggtacctaacgggtacctaggtttaattaacgtttaaacgtaccttacccgtaccggtaacccgggttttacggaaccccggtaaacgggggttaacctaaacggggttaacggtaaaacgttaaccgtaaaagggttaaacccggtgtaccgggtacgtacgggtccctaaaccggntttacccgttgtaaccctttacgtacttacccggtttacccccacggttatacccttaaacgg

SEQ ID NO: 169378 - DNA, 709 bp, Homo sapiens
  misc_feature: GYAE6OF01BM2IS.37.11.A11.1.454.CMB.1.raw
tcagtagtgtagatcacgaccggtgctcgatttagctacgactgcaggggcagcaagatggtgttcgcagacccaggtcttctatttctctgttgctctggatctcgtggtgccgtacgggacaccgtgatgacccagtctccagacctccctggctgtgtctcgtgggcgaggacggcctcatcaactgcaagtccagccagtacttgttttacacagcctaccaaacaaataacgaacttacttaagtcttaggtatacaggaccaacgaaaccgaggccacgtacctacctaaactcgcttactactttacgtcggacctacgtcccggtaacccggggacggttcccggggtacctacggacccgtagttaccgagggtcggccggtacgggtccggttcgtacgggaactaggtactttaccacgttacctaccactactaccgaaacgtcgaccccgtggaccgaggtccgtaggtaggttacgtggttacggttacgttaaagttttacgttaacgtacgtacgacgttacgttagttaacttacgtaaaccttcccgtaacccgtccggtaacgttaccgggaccggtaaacgggtaaccgttaaggtaacgtaaacgaacgtaaaccggaggttacgtaggacctacgacctactattccgtcgttactaccgtcttaccctcccgtactcgtcgttaac

SEQ ID NO: 169379 - DNA, 1005 bp, Homo sapiens
  misc_feature: GYAE6OF01C4VFA.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtggcgagcgggcctaccatcgaactgactaagtccagccaggtactttgttttaacacgacgtacctaaccaaaacaataaacgtaaccttactttaacggacgtttaggtactacgtaagtacgaaacgaaaccggaacgggaccttaccggtacccgttaaccgttaaacgtacggtaccttaaccttaacgtttaccggtcgggtaacctaccgttaccggtaccccgggggtaaccggttccccgggggtcccttacgggtaacccgttacgttacgtaacgggttcggacggtaacgggtcgggtaccggttaggaaccgtacgtttacgttacctaccgtaccgtacctaaccacgttaccgaaacctacggtaccgttacggacggtacggtaccgtagggtacgggtttaacgttcggtacgggttaacgtttacgttttaaccgtttaacggtaccgttacgtaacggttaaccgttaaaggtttaaacttttaaacgttaaacccggtttacccgttacccggggtttacccgttaaacccggggtttaccgggaaaccccccggggtaaaacggggttaaaccccggttaaaaggggttaacccggttaaaacccgtttaaaccgggtaaaaacccggtttaaccggggttaacgggttaacccggggtaaccgtttaaccccggtaacccccggttaaacccggtttaaccgtttttaacccggggtttaaccccttttaaccccgggttaaccctttaaaccccccggttttaccccggttttaacccccggttaaacccttaacccgttttaccccgggttaaaacccg

SEQ ID NO: 169380 - DNA, 827 bp, Homo sapiens
  misc_feature: GYAE6OF01BG2ZI.37.11.A11.1.454.CMB.1.raw
  modified_base (211)..(211): a, c, t, g, unknown or other
  misc_feature (211)..(211): n is a, c, g, or t
  modified_base (313)..(313): a, c, t, g, unknown or other
  misc_feature (313)..(313): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttanacagctaccaaacaataaacgaactacttagtcgttaggtatacgagacaacggaaaaccgagggaccacgccttacctaaactgtactactactttacggngggtccaacgtccggtaaccccggggtaggttcccggggttacccgtaggtaccgtattcgaaggtcggacgtacgggtccgggtcgtagggactaaggtactttaccgaccttcgtacctaacaacgttacaaaccgtacgcccgttacggcgtagggtccgtaggaacgggtagttacgggtacgggttacgttaacgttttaacttaaccggttaggttaccgaacggttacctaaaggtttaattaacgtttaaccgttacccgttaccccgttacccgggtaaccgggtttacccggaaccgggtaaaccggggtaaccggttaaacgggtaacgggttaaaccttaaacccgggtaaaaaccggtaacggttcgggttacgggaacccgttacgggtaaaccccttaacccgttactttaacccggttaccggttttaccctttaaccgttacccggtttacccccgtttaaccccgtcccgtttaaaccgtttcccgtttaaaccgg

SEQ ID NO: 169381 - DNA, 954 bp, Homo sapiens
  misc_feature: GYAE6OF01AWDTU.37.11.A11.1.454.CMB.1.raw
tcagtagtgtagatcacgaccggtgctcgatttagctacgactgcagggggcagcaagatggtgttgcacgacccaggtcttctatttctctgttgctctggatctctggtcgccgtacggggacaccgtgatcgacccagtctccagacctccgtggctgtgtctcgtgggcgaggacgggcctcatacaactcgacaacgtccacgccagtactttagttttaactacgacgcctaaccaaactaaagtaaacgtaaccttacgttacgtcgtttaggtactacgacgaccaacgaaaccggagggaccacgtaccccttaacctaaactcgaccttacttaactttaccggtgggacctacgttacccgggtaaccccggggtaccgggttccccggggtaccctacgggtacccgtacttaccggagggtcggaccgacgggtccggggttcggtacgggaacctacggttactttacccgaccgttccctaccgaaccctaactaacccaaaccggtaccgtcccgttacgggaccgtaacgggggttccgtaacggggtaaacgggttacggtttacgggggttaacggttaaccggtttttaaacttttttaaccgttaacggtttaccgggttaacccgtaacgggttacgttaaaacggttttaaacttttaaacgttaaaacccgttttacccccggttaccccgtttaacccgggggtttaccccggtttaaccggggaaaccccggggtaaaaaccggggttaaccgggtaaaaggggtttaaaccggaaaaccgtttaaacccggaaaaaccggtttaacgtcgggttaccggtacccgtaacggtaccccttaaaccgttacgtttcccgttaccgtttactttaccccgttaccgtttacccccgtacccccggtacttaccgttaaccgttaacccgg

SEQ ID NO: 169382 - DNA, 793 bp, Homo sapiens
  misc_feature: GYAE6OF01EAJ1N.37.11.A11.1.454.CMB.1.raw
  modified_base (708)..(708): a, c, t, g, unknown or other
  misc_feature (708)..(708): n is a, c, g, or t
tcagtagtgtagatcacgaccggtgctcgatttagctacgactgcaggggcagcaagatggtgttgcagacccaggtcttcatttctctgttgctctggatctctggtcgccgtacgggacaccgtgatcgaccctagtctccgacgacctcccgtggctgtcgtctcgtgggacgaggacggcctccatacaactcgactacgtccacgccagtactttgtttaacacgactacctaccaaactaaactaacgtaaccttacgttagtacgtttaggtactcgaacgacgaaacggaaaccggtacggaccaccgtacccttacctaaacgtcgtacttacgttacgtttcgacggcctaccgttacccgggtacccggggtacggttccccggggttaccctacggtaccgtttgttaccgtaggtccggtacggtacgggtccgggtacgtagggacttacgttacttccgtactaccgtaccaccgtactaccgaacgtccgtactcggacgtacggtacggtaggtacgtgtacggttacgttaacgttaattttaacgttacgtcggttaacacgttaacgttaactttacttaacttaacccttaccggttcccgggttaacccggttaccggtaacccgggtaacggtaaaccgggtaacggttaaacgggttaaacgtaaaccctaaggtaaacccggngttacggtcgaccctaacgtccgttaacctagtttcgttaccttacgttaccctacccggttccctaccgtacttagtacctacg

SEQ ID NO: 169383 - DNA, 708 bp, Homo sapiens
  misc_feature: GYAE6OF01EVHXM.37.11.A11.1.454.CMB.1.raw
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagacttgttttanacagctaccaataataagaactacttagcttggatcagcagaaaccgaggacacgcctacctaactgtctactaatttacnggctagttaccccnggtacccgggtccgggtcccggtccgtacgtaccgtacttacgtacggtcggacggtacggtcgggtacggtacggacgtagttacttacctacctacctacctacctaactaaccaaccgtaccgtccgtacgacgtacggtacgtacggtaggtacgttacggtacggttacgttatttacgtttacgtacgtacgagtacgtaattaacgttaacttaacgttaccgttacccgttaccggtaccggttaccggtaacccggtaaacggtaaccggtaaacgggttaacggtaaacgtaaaccgtaaacgtaacggttacggtaccgtacgtaccgtactaccgtacgttacgttacgttaccttaccttaccgttaccccgttacccgtccgtacgttacc

SEQ ID NO: 169384 - DNA, 696 bp, Homo sapiens
  misc_feature: GYAE6OF01DEO1O.37.11.A11.1.454.CMB.1.raw
  modified_base (213)..(213): a, c, t, g, unknown or other
  misc_feature (213)..(213): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggagggcctccatcaactgcaacgtccagccagtacttgttttanacagcctaccaacaataacgaacttacttagcttggtatcgagacaagaaccgagggccacgtaccctactaaactcgtactctatttacgcgggactacgttccggtacccgggacggttcccgggtaccctaggaccgtagttacgaggtcgacgtagggcgggtcgtacgggactagttacttcactaccgtacaacctaactaccgaacgacgtccctacggacgacgggtacttaggacggtagtcggtaggtacgtttaattttacgtacgtcgtacagtacttagttaacttaattaactaccttcccgtaccggttaaccggttccggaaccggaaacgggtaacgtaagggtaacgtaaacgtaccgtaaaacggtacgtggtaccggtactacggaccctaacctagtttcccgttagtttcccttaccgttaccgttaccccgttacccgacccgttaagtccgttaaaccg

SEQ ID NO: 169385 - DNA, 620 bp, Homo sapiens
  misc_feature: GYAE6OF01CXZFL.37.11.A11.1.454.CMB.1.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (564)..(564): a, c, t, g, unknown or other
  misc_feature (564)..(564): n is a, c, g, or t
tcagtagtgtagatcacgaccggtgctcgatttagctacgactgcaggggcagcaagatggtgttgcagacccaggtcttcatttctctgttgctctggatctcgtggtgccgtacggggacaccgtgatcgacccagtctaccagactccctggctgtgtctcgtggcgagacggcctccatcaactgcaagtccagccagacttgtttanacagctaccaanaataagaactactagcttaggtaactcagcaagaaccgaggacacgcctaactaaactgacctactattaccgtggctaactcgtaccggtagtcccgggtcctacgaaccgtagttaccaggtcggacgtaggccgggttacgtagggaactagtacgtttcacgttcctacaacctataccaaacgtcgcccgtagacgtagtaccgagaggtactggtaggtacttaatttaacgtatggacctagtacaagtttattaactaagttccctactaccggtacgttaccggccgaaacgggtaccaagggtaacaagtaccaaacgtcgcgttacggntaccgacctagacttccgttgtacttactaccttccttacccggctattccggaac

SEQ ID NO: 169386 - DNA, 599 bp, Homo sapiens
  misc_feature: GYAE6OF01BKF1Q.37.11.A11.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (383)..(383): a, c, t, g, unknown or other
  misc_feature (383)..(383): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctcctggctgtgtctctgggcgagaggcctccatcaactgcaagtccagccagtacttgttttanacagctaccaanaataagaactattagcttggtatcagcaagaaaccgnggcagcctactaactgacttctatttcgnggacctagtccgtacccgggaggttcccgggtcctggaccgtattcgaggtgcgaggcgggtgacggacagtacttcgactctcaacatacgaacncgtcctgacgaggtctaggagtgtggtacgtacgttaatttacgtactcgtacagtactagtttaactactaacgttccctaccgtacggtaccgttccgggaaccgaacgggtaccgaaggtacgaaactaccgaacggtacctggtagacctcgacctaccgtattccgtagtttaccctacgtaccttacccctcccgacctagtccctaacg

SEQ ID NO: 169387 - DNA, 647 bp, Homo sapiens
  misc_feature: GYAE6OF01DZ19U.37.11.A11.1.454.CMB.1.raw
  modified_base (303)..(303): a, c, t, g, unknown or other
  misc_feature (303)..(303): n is a, c, g, or t
  modified_base (410)..(410): a, c, t, g, unknown or other
  misc_feature (410)..(410): n is a, c, g, or t
  modified_base (457)..(457): a, c, t, g, unknown or other
  misc_feature (457)..(457): n is a, c, g, or t
  modified_base (492)..(492): a, c, t, g, unknown or other
  misc_feature (492)..(492): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggcggcctccatcaactgcaacgtccagccagtacttgttttacacagcctacaaaacaagtaacgaacttaacgttagtcgttaggtatcaagaccgaacgaaaccgaggccaccgtacctaacctaacgtncttactaagtttcgacggcctaacgtcccggtaacccggggtcggttcccgggtccacggtaccgtatacgagtcggacggtcggcggtcgtaggactagtcttacnctctacactagaccaacgtcaccgtggactggtacgtaggagtacgngggttacgtagtttacttagtacgtcgttaaccgntaacgttaattaattacgttaaactcccgtacgtaccgtaacggtccgaacggtaagggtaccgtaaggaacaacgttacgaaacgtgtacgtcgcgtaaccgtcaacgttctccgttattcctacgtccttacccgtacctcttagtacgttac

SEQ ID NO: 169388 - DNA, 689 bp, Homo sapiens
  misc_feature: GYAE6OF01B3XQJ.37.11.A11.1.454.CMB.1.raw
  modified_base (209)..(209): a, c, t, g, unknown or other
  misc_feature (209)..(209): n is a, c, g, or t
  modified_base (291)..(291): a, c, t, g, unknown or other
  misc_feature (291)..(291): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaaacaaataagaactacttagcttggtatcagacaagaaaccgaggcacgcctacctaaactgctctattacnggcagtccgtacccgggcgttccgggccctgaccgtattcgagtcggcgaggcggtcgtggacagtattcactctaccacctataccaacacgtccgtgacaggctaggaggtatggtggtaccgtaattttacttacgtcgtcgacgtacgtaagttaattaacttaaacgttacccttacccgttaccgggtaacccggtttacccgggaacccggtaaaaccgggggtacccggttaaaagggtaacccggtaaaacgttaacccgaaaaaaccgggttaggttacgggtaccggtacccgttaggaccctaacccgttagttcccgttacggtttccctttaccgttaacccgttccccgtttaacccccgccttaaccgtttacccttaaacg

SEQ ID NO: 169389 - DNA, 624 bp, Homo sapiens
  misc_feature: GYAE6OF01A6YNL.37.11.A11.1.454.CMB.1.raw
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (605)..(605): a, c, t, g, unknown or other
  misc_feature (605)..(605): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtggggcgaggacgggcctccatcaactgacaagtccagccagtacttgttttanacacgctaccaaacaataaagaacttacttagcttggtatcagcaaggaaaccagggcacgtaccctacctaaactgactactatttacgngggactacgtcccggtacccggggtacggtcccggggtaccctacggaccgtattcgaggtcggacgacggtcgggtcgtaggactagtacttcactctacacatcaacgcgtacctgcgaggctaggaggatggtaggattaatttacgtcgtagtacagtcttaagttattataacttaccctccgttaccgtacgggttaccgaccggtaaacgggtaccgaaagggtacgtaaactaccgaaaacgtacgtggtacggctaccggcctaactgttcgtattcctactcttacccncccgtactagttcctaacg

SEQ ID NO: 169390 - DNA, 857 bp, Homo sapiens
  misc_feature: GYAE6OF01C2QGJ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctcagacctcccgtggctgtgtctcgtgggcgagacgggcctccatcaactgcaacgtccacgccgagtacttagttttaacacagtctaccaaacgtaaaataacgtaacttaacgttacgtactttaggtaatacgacgaccgaaacggaaaccgaagggccaacgtccctaacctaaacgtgtaccgttactaagtttaccgtcgggactacgtacccggtacccgggggtacggtcccggggtaccctaggtaacccgtacgtttacggacgggttcgggaccgtaacgggtcgggtacggttacgggaaaccgtaaggttaactttacctaaccgtttaccgtacccaaccgtaacgtaccaaaccgtacgtacccgtaggaacgaccgggtcgtaagggtaacgggtcggttcgggtaacgggtacccgttttaaacgttttaacgtttaccggtttagacccgtaaggtaacctttaaaggtttaactttaaacgtttaaacttacccgggttaccccccgttaacgggttaccgggttaaccccggacccggtaaaagggggtaaccctaaagggggttaacaaaacgtttacccgaaaacggtacgtttaggaccggtaccgttacggaccttaaacccggtctttcgttacccggtttcctaaccttccggttaccccctttacccggcttaaaccgtgtttaaacccgg

SEQ ID NO: 169391 - DNA, 690 bp, Homo sapiens
  misc_feature: GYAE6OF01CB0VH.37.11.A11.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctcatcaactgcaagtccagccagtactgttttanacagctaccaaanaataagaacttacttagcttggtatcagacaagaaaccacgggcacgtccctacctaaaactcgctactatttacgtggctacgtccgtacccgggtacggttcccggggtccctacggaccggtacgttcgaaggttcggccgtagggtccgggtcgtacgggtaacagttactttaccgacctccgttaccaacccgtactaccgaaacctacgtcccgtaggccgaagggtccgtagggaacggtagttacggtaggtacgtttaatttaacgttacgtacggtctaagtctaagttaacttaacttaacgtaccttcccgttaccggtaccggtttaccggaacccgtaaaggggaccgtaaagggtaacgaaacgttaacgaaaccgtacgtggtacggactcggacctaccgtacttcgtcgttcctaccgtacttcccgttacccgcctacgttacgtaaccg

SEQ ID NO: 169392 - DNA, 672 bp, Homo sapiens
  misc_feature: GYAE6OF01D3KH5.37.11.A11.1.454.CMB.1.raw
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (397)..(397): a, c, t, g, unknown or other
  misc_feature (397)..(397): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagcgggcctccatcaactgcaagtccagccagacttgttttanacagctaccaaacaataagaactacttagcttggatcagcaagaaaccnggcagcctactaaactgactctatttacgnggcagttccgtaaccggggtgttcccgggtccctggaccgtattcgaggtcgacgaggtcgggtcgtagggacctagtactttccacgttctacaacctatacaaacncgccctagaccgaggctaggacggtagtggtacggtcttaatttacgttacgtgttaccgaagtcgtaagttaactttaagtaaaccttacccgtacccgttaccggtaaccggtttacccgggaaccgtaaacggggtaacccgtaagggtacgtaaaacttaccgaaacggtaaccgttggacccggtactaccggtaaccctaaccgttactttacccgttttaccctacgtacctttccccgttacccaccgttactccgttacgtaaacc

SEQ ID NO: 169393 - DNA, 861 bp, Homo sapiens
  misc_feature: GYAE6OF01ALT4H.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctcccgtggctgtgtctcgtgggcgaggacggcctccatacaactgacaacgtccagccagtacttagttttaacacacgcctaccaaacaataacgtaacttacgttagtcgttagtatcgacgtacaaacgaaaccgaggaccacgtaccctaccgtaaaacgtcgtaccttacttaacgtttaccggagggtacctaaccggttacccgggtaaaccccggggttaccgggtttcccccgggggtaccctacggtaacccgttagtttccggaacggttccggacggtacgggtccgggttcggtaacggaactagttacctttaccgacctttccgaccaaccgtactaacccgaacgtacgtcccgtacggacgtacggtcgtagggacgtaggtacggtcgggttaacgttttaaacttttacggttacgttacggttacgaacgttaacgttaaagtttaactttaaacgttacccgtttacccgttacccccgtttaccgggttaaacccggttacccgggaaacccgggtaaacggggttaacccggtaaaacggttaacgggaaaacccttaaaccggaaaacggttaaccggttcgggtaaccggtaccgtaaccgtaccttaacccgttacgtttacgttaccccgtttacttacccgttacccgtttaccccgacccgtaaccttacgtttccgttaaaccg

SEQ ID NO: 169394 - DNA, 736 bp, Homo sapiens
  misc_feature: GYAE6OF01CWQNO.37.11.A11.1.454.CMB.1.raw
  modified_base (170)..(170): a, c, t, g, unknown or other
  misc_feature (170)..(170): n is a, c, g, or t
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
  modified_base (726)..(726): a, c, t, g, unknown or other
  misc_feature (726)..(726): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgtagnggcctccatcaactgcaagtccagccagtacttagttttanaccagacctaccaaactaataacgaactacgttagctttggtactntaacgcaacgaaaccgagggtaccaacgtaccctaccgttaaactcgtaccttaccgtaatttaccggtcggggtacctaacgttccggtaaccccgggggtacggttaccccggggttacccttagggtaccccgtagttttccgaacgggttcgggaccggtaacgggtccggggttccgttaggggaaacctaggttaactttccgaactttccgtaccaaccgtctaccaaaacgtcgtaccccgttgaccgttagggccttaggacggtagttcgggtacggtacgttaacttttaacgtacgttcggttacaggtacctaagttacttaactaactacctccgtacgtacggttcgaacgtaagggtacctaaggttacgaactaccgaaaaggtcgtaggtcggtaccaggtacccaagtcctcggttcttaccgttactaaccttcccgttcccgaccgtntccgttaacg

SEQ ID NO: 169395 - DNA, 674 bp, Homo sapiens
  misc_feature: GYAE6OF01BYXN8.37.11.A11.1.454.CMB.1.raw
  modified_base (372)..(372): a, c, t, g, unknown or other
  misc_feature (372)..(372): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgacctctatttactgggcatccgtacccgggagtccggggtcctgaccgtattcagtggcgagcgggtctggacagtatttcactctcacctatacaacngcctgcgagctggaggatggtggtacgtattttacttaccgtgtccagtcctaagttatttaacttaacgttacctacccgttaccggtaccggtttaccgggaccgtaaacgggggtaacccgtaaaggggttaacggtaaacgttaacccgaaaaaccggttaaccgttacgggttacgggtaccgtttacggacccttaaccccgtaaacgtttcccgttaccggtttacccctttaccgtaaaccgttttccccctttaaccccccggtccccgttaacgtttcccgtttaaacccgg

SEQ ID NO: 169396 - DNA, 704 bp, Homo sapiens
  misc_feature: GYAE6OF01CAGWF.37.11.A11.1.454.CMB.1.raw
  modified_base (208)..(208): a, c, t, g, unknown or other
  misc_feature (208)..(208): n is a, c, g, or t
  modified_base (288)..(288): a, c, t, g, unknown or other
  misc_feature (288)..(288): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactactagcttggtatcagacaagaaaccaggcagtcctacctaaactgctctatttacgnggctagtccgtaccgggagtcccgggtcctgaccgtattcgaggtcgcgtacggcggtcgtggactagtatttccgactctaccgaccatactaacgacgtcctacgctacgggctaggacggtagttggtacgggtactttaagttttaactaacgttcggttaccgaaggttaacccgttaaagtttaaacgttttaaacttaaaccgtttaccccgttaccccgtttaacccgggtttaacccgggttttaaccgggaaccccggtaaaacgggggtaacccgtaaaggggttaaacggaaaaccgtttaacccgaaaaagggtacccgttagggtacggtaccgtaccggacctaacctacgttcgttcgtaacctttcaccgtttccctacccgtacctagtccgtaaacg

SEQ ID NO: 169397 - DNA, 640 bp, Homo sapiens
  misc_feature: GYAE6OF01AHJPK.37.11.A11.1.454.CMB.1.raw
  modified_base (356)..(356): a, c, t, g, unknown or other
  misc_feature (356)..(356): n is a, c, g, or t
  modified_base (626)..(626): a, c, t, g, unknown or other
  misc_feature (626)..(626): n is a, c, g, or t
tcagtagtgtagatcacgaccggtgctcgatttagctacgactgcaggggcagcaagatggtgttgcagacccaggtcttcatttctctgttgctctggatctctggtgcctacgggggacaccgtgatgacccagtctccagactccctggctgtgtctcgtgggcgaggagggccctccatcaactgcaagtccagccagtacttgttttaatacagcctaccaaacaaataagaacttacttagtcttggtatcagacaacgaaaccgagggacacgtccctacctaaactcgctactatttacgtggcctacgtccgtacccgggtacggttcccgggtccctcgtaccgtnttcgaggtggacgtacggtcgggtcgtacggacgtacgtacttaccactctaccacctataccaactcgctagcgaggtctaggaggtgtggtacggtacttatttacgtacgttagtcgagtactagttaattaacttaactacctccgtaccggtacggtaccggaacgtaacgggtaaccgtaaggtacgtaaactacgaaacggtacgttggtacggctacggacctaccgtattcgtacgttccttactacctttcccgtacccncttactcgtaaacg

SEQ ID NO: 169398 - DNA, 701 bp, Homo sapiens
  misc_feature: GYAE6OF01E1RWI.37.11.A11.1.454.CMB.1.raw
  modified_base (208)..(208): a, c, t, g, unknown or other
  misc_feature (208)..(208): n is a, c, g, or t
  modified_base (301)..(301): a, c, t, g, unknown or other
  misc_feature (301)..(301): n is a, c, g, or t
  modified_base (410)..(410): a, c, t, g, unknown or other
  misc_feature (410)..(410): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgaccagtctcagactccctggctgtgtctcgtgggcgagagggcctccatcaactgcaagtccagccagacttagttttanacagctaccaacaaataacgaactacttagcttaggtatcagacaacgaaaaccgagggcacggcctacctaaaactgactactactttacgngggacactccggtaacccgggaggttcccgggtaccctgaccgtgttcgaggtcggacgacggcgggtcgtaggacagtactttcgaccttctacaaccatacaaaccngcgtacgcgacggtcagggagagttcggtacgggtactttaagtttatttacgtcgtacgtagtaccgtaagtttaactttaactaaacgtttaacccttcccgtaccgggttaccggtttacgggaacccgtaaacggggaacccgtaagggttaaacgaaacgttaacgaaaaccgggttactcggtacgggtcctacggtaccgtaacccgtacttcccggttcgttaaccctttaccgtaacccgttttacccgtacccctcccgttaaccgttacgttaaacccgg

SEQ ID NO: 169399 - DNA, 851 bp, Homo sapiens
  misc_feature: GYAE6OF01DID1I.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacacgtgatcgacccagtcctccagacctccctggctgtgtctcgtgggcgaggcggcctccatcaactgacaacgtccagccagtacttgtttactacgatcctaaccaaataaacgtaactaaccttacgttaacggtccgtttaggttaaccacgtaacgaaccgaaaacggaaaacccggacgggtacccgacgtaaccccgttaacctaaaacgtccggtacttacctaacgttttaacggcgggacctaccggttacccgggtacccggggtaccgggtttacccgggtaccgtaccggtaacccgttagtacgtacgggtacgtcggtacgggtcgggtaccgtggaacctaggtactttccgactcgtaccgaactacgtacctaaccgtcggtactacggtggaccggtacggtacggtcggtaaggttcgggttacgtaacgtttacgtttaacgttcggtacgtaccggtaagttacggttaaactttaactttaaccgtttaaacccgttccgtttaaccccgtaccgggtaaccccgggtttaacgggtaacccggtaaaccgggggttaacccggtaaaagggttaacggtaaaccctaaccgggtaaacttaacccgggtgggtaaacccgacgtaccgtaaccgttacctacgtttccgttaacgtccttttaacccgtccgttacccctccgttaacgtagtttaacccgaacg

SEQ ID NO: 169400 - DNA, 757 bp, Homo sapiens
  misc_feature: GYAE6OF01CL8K6.37.11.A11.1.454.CMB.1.raw
  modified_base (100)..(100): a, c, t, g, unknown or other
  misc_feature (100)..(100): n is a, c, g, or t
  modified_base (220)..(220): a, c, t, g, unknown or other
  misc_feature (220)..(220): n is a, c, g, or t
  modified_base (285)..(285): a, c, t, g, unknown or other
  misc_feature (285)..(285): n is a, c, g, or t
  modified_base (322)..(322): a, c, t, g, unknown or other
  misc_feature (322)..(322): n is a, c, g, or t
tcagtagtgtagatcacgaccggtgctcgatttagctacgactgcaggggcagcaagatggtgttgcagacccaggtcttcatttctctgttgctctggntctctggtcgccgtacggggacaccgtgactcgacccagtcctccagcctcccgtggctgtcgtcgtcgtgggcgaggcggcctcatcactgcaagtccagccagtactttgtttacacncgactaacaaataaactaacgtaacttaacgttagtcgttaggtactacacgacaaacggaaccngggtaccacgtacctacaactcgacttctagtttcgngactacgtcccgtaaccggggtcgtacccgggtccctaggaaccgtcgtcgacggtcggtaccgtcgggtacggtcgtacggtacgtagttacctcccgtactcctaacaccgtattaacccgacgtaccgtctaggactacgggtacgagggtagtacggtacggttacgtacgtttaagtttacttacgacggttaacgtacgtacgttaaagttaactttaacgtaccgtttacctaccggtttaccgggtaacccgttacgggaaccggtaaaccgggttaacgggtaagttaaacgggaacctaacgggttaaccgtaggttccggttacgggacccttacggtaaccttaccgttacctttcggttacctttaccgttaacccgttcccgtttacccgaccccggttacttaaccgttaccgttaaacg

SEQ ID NO: 169401 - DNA, 778 bp, Homo sapiens
  misc_feature: GYAE6OF01EC5DX.37.11.A11.1.454.CMB.1.raw
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttatacagctaccaacaataacgaacttacttagcttaggtatcagacaagaaaccgagggccacgacctacctaaactgctctatttacgngggctacgttccggtacccggggacggttcccggggtcctacggaccgtagttccgaggtcggacgtacgggccgggtcgtacgggacgtaagttactttaccgaccttacgtcccaacccgtactaccgaaactacggtccttacggacgtacggggtactacgggtaagggtacttacgggtacgggttaccgtttaaattttaacgttaacgttcggtaacgtaacgtaccgtttaaatttactttaaacgttaaaccttccccgttacccggttccggttaaaccgggttccgggaaacccggtaaacggggtaacccgtaaaagggggttaacgtaaaacttaacccggaaaaaccggttacgtacgggttaccgggccttacgggaaccccttaacggttacgttcccggttagtttaccccttaccttaaccgttcccccttaccccggtaccttaagttcccggttaaacg

SEQ ID NO: 169402 - DNA, 712 bp, Homo sapiens
  misc_feature: GYAE6OF01CSW90.37.11.A11.1.454.CMB.1.raw
  modified_base (488)..(488): a, c, t, g, unknown or other
  misc_feature (488)..(488): n is a, c, g, or t
  modified_base (506)..(506): a, c, t, g, unknown or other
  misc_feature (506)..(506): n is a, c, g, or t
tcagtagtgtagatcacgaccggtgctcgatttagctacgactgcaggggcagcaagatggtgttgcagacccaggtcttcatttctctgttgctctggatctctggtcgccgtacggggaccaccgtgatcgacccagtcctccagtacctcccgtggtctggtcgtctcggtgggcgagcgggcctacatctaacgtcgactaacgtccgacgacctagtactttagtttacacacgaccctaacaaacgtaaactaacgtaacttacgttagcgttaggactacagaacaacgaacgacggcacgtcctaacgtaactcgaccttctacgttacgcggtacctacggttcccgggacccggggtaccggttccccgggtaccgtacggtaaccgttacttacgggaacgttcgggacggtcgggtccgggtacgtacgggaactagtttacgttaaccattcccgtaaccgaactactcgaaacnccgactgacgtgcgtagngtgtacggtgtacttaagttaatacgtcgtacagttacgtaattacgtaactaccttaccctaccggtccggtacgtaccgggaacggtaacgggtaacgtaagggtacgtaaaccgttacggaaacgtaggtcgtacgtaccgacgtccgtacttacttccggttactcgttaccttaccttcccgtaccacttactaccgtaac

SEQ ID NO: 169403 - DNA, 639 bp, Homo sapiens
  misc_feature: GYAE6OF01C4U25.37.11.A11.1.454.CMB.1.raw
  modified_base (228)..(228): a, c, t, g, unknown or other
  misc_feature (228)..(228): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagacgggcctccatcaactgacaacgtccagccagtacttgtttacacagcctaccaaanaaataaacgtaacttacttagtcgttaggtactcgaacgacaacggaaaccgacgggaccacgtaccttaacctaaactcgacttactacgtttacgtcgggactacgtacccggtacccggggtacggtcccgggtccctacggaccgtagttcgaggtcggacgaggtcgggtgtacggaacgtagtacttacaactctaccgactactacaacgacgtctacgagacggactagggagtacgtggtaacggtcgttaattttactcgtctacgacgttactaagttaattaactactaccgtcccgttacggacgttaccggacgaacggtacgaaggtacaaacagaacgtagcagcgtagacctatacgtcttcgttactccttacctccgtaccactgtctaacg

SEQ ID NO: 169404 - DNA, 779 bp, Homo sapiens
  misc_feature: GYAE6OF01BF8LF.37.11.A11.1.454.CMB.1.raw
  modified_base (209)..(209): a, c, t, g, unknown or other
  misc_feature (209)..(209): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaacaaataagaacttacttagcttggtatcagacaacgaaaccgnggacacgccctacctaaactgactctaactttacgngggactacgtaccgtacccggggacggttcccggggtcccgtaggtaccgtattcgaggtcggcgtaggtccgggtcgtacgggactaggttactttaccacttccgtaccaaccgtaactaacccgaaaaccgtacggtacccgtaggtaacccgtaaggggtcccgttaaggggaacgggtagttcgggttacgggtaacccgtttaaatttttaaccggtttacttacgggttaccgtaaggttaaccgttaaacggtttaaattttaaacgtaaactttaccccgtttcccggtttaacccgggtaacccggtttaaccgggaaccccggtaaaacgggggtaaaccccgtaaaggggttaaacggtaaaaacgtaacgtaaaaccggtacgttaggtcggtaccgtacgtaccctaacctcgttccttcgttccgttaccttaccgttccgttcccccgaactcgttaactaacg

SEQ ID NO: 169405 - DNA, 715 bp, Homo sapiens
  misc_feature: GYAE6OF01A7PBR.37.11.A11.1.454.CMB.1.raw
  modified_base (211)..(211): a, c, t, g, unknown or other
  misc_feature (211)..(211): n is a, c, g, or t
  modified_base (304)..(304): a, c, t, g, unknown or other
  misc_feature (304)..(304): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttagttttanacagctaccaaacaataaacgaactacttagcttaggtatcagacaaggaaaccgagggacacgacctactaaaactcgactactatttacgngggacctatccgtacccgggtagtccggggtccctgaccgtattcgagtcggcgaggtcggtcgtacggacaggtacttcacgtctacaacctagtacaaccgagtcctacggacgtacggcgttagggaacggtagtgggttacggtaccgtttaaatttacgttaactggtaaccgtaacgtacgttaacttaattaagttaaacttaccgttaccccgttaccggtaacggtttacccgggaacccgttaaaacggggtaaccggtaaagggttaaacggaaacttaacccggaaaaacggtaacggttaccgggtagggtaaccctaggtaacccctaacgttaattcggttacgttaccgtttacctaaccggtttcccttacccccggacttactcggttaaacg

SEQ ID NO: 169406 - DNA, 614 bp, Homo sapiens
  misc_feature: GYAE6OF01CKFBV.37.11.A11.1.454.CMB.1.raw
  modified_base (259)..(259): a, c, t, g, unknown or other
  misc_feature (259)..(259): n is a, c, g, or t
  modified_base (344)..(344): a, c, t, g, unknown or other
  misc_feature (344)..(344): n is a, c, g, or t
  modified_base (509)..(509): a, c, t, g, unknown or other
  misc_feature (509)..(509): n is a, c, g, or t
  modified_base (580)..(580): a, c, t, g, unknown or other
  misc_feature (580)..(580): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctcgtgggcgaggacgggcctccatccaactgcaacgtccagccagacttcttttcgtcagtcgtacgacaaataagaacttactttgcttggtaaccaanagaaagcaggaacacgcctaccttaagttcgctctactttacgtcggcactcccgacccgggcaccgtcccgggtcctcgaccgnttcaggcggcagggtcggtcgtgggactagtacgtttccgctcctaccaccactcagcacgcctggcgaggcctaggaatcgtaggtggttactagttttacttcttcgtcgtgtacgttagtacggttttgggtacccttccggttaccggttccgttccgggngtaccggaagggtaccgagggtacggacgataccgaacggcgtaacgtggtcggtacgtacgcctaaccgntaccgttcgttacttcctacttcccgtcccgtcg

SEQ ID NO: 169407 - DNA, 709 bp, Homo sapiens
  misc_feature: GYAE6OF01C46U7.37.11.A11.1.454.CMB.1.raw
  modified_base (278)..(278): a, c, t, g, unknown or other
  misc_feature (278)..(278): n is a, c, g, or t
  modified_base (420)..(420): a, c, t, g, unknown or other
  misc_feature (420)..(420): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtcctccacgtacctcctggctgtgtctcgtgggcgaggcggcctcatacactcgacaacgtccagccgaagtacttagttttacacacgtacctaacaaaactaaataacgtaacttacgttacggtcgtttaggtaacncaacgacgaaacgaaaccggacgggacaacgtaccctaacctaacgtctccttacgttacgtttacggtacggtactaccgttacccgggtaacccggggtaccggtccccggggttacctaccggtacggtattacccggngggtcggacgtagggcggttcggtacgggaactcgtacttctaccgtaccaccgtaacctactaccaaaccgtcgtaccagggtcgacgtacgtagggacgtagtcggtagtacttaacgtttatcgtcgacgtatacgttagttacttacgtaacgttcctccggttacgaccggttacggaccggtaaaggaaccgtaagtacgtaaacgactaacggtacgtgaccgtactacgtaccacttacgtcggttactccgttactacccgtccctaccgctgtgtaacc

SEQ ID NO: 169408 - DNA, 746 bp, Homo sapiens
  misc_feature: GYAE6OF01AEQLS.37.11.A11.1.454.CMB.1.raw
  modified_base (212)..(212): a, c, t, g, unknown or other
  misc_feature (212)..(212): n is a, c, g, or t
  modified_base (267)..(267): a, c, t, g, unknown or other
  misc_feature (267)..(267): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgccaagtccagccagtacttgttttanacagcctaccaacaataacgaaccttacttagcttggtatcagacagaaaaccgngggacacgcccttacctaaactcgcttactaacgtttaccgcgggtactacgttaccggtaccccggggacggttccccggggtaccctcggaaccgtacgtttccgaggttcggaccgtacgggtccggggttcgtacgggtacctacggttaactttcccgaaccgtttccctacccgtaacccgtaacgttacccgaaaccgaccggtcccttacgggacccgagggtccgtagggaagggtacgtcgggttacggtacgtttaattttacgttacgtagtccgtagtacgtagttaacttactaacctcctttacccgtaccgtaccggttaccggaaccgtaacgggtaaccgtaagggtacgtaaacgacccgtaaaacgtacgtggtaccggtactacggtaccctaaccggtgttccgttaccgttccttacctaccgttcccccgtttacccgccttaccgttccgtaac

SEQ ID NO: 169409 - DNA, 849 bp, Homo sapiens
  misc_feature: GYAE6OF01DUCAK.37.11.A11.1.454.CMB.1.raw
  modified_base (254)..(254): a, c, t, g, unknown or other
  misc_feature (254)..(254): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttaacacagcctaccaaactaaataacgaaccttacttagctttggtanacgagacaacgaaaccgagggccacgtccctaactaaactcgtactactactttacgtcgggactacgtcccggtacccggggtaccggttccccggggtccctcggaaccgtacgttacgaggtcggcgtagggccgggttcgtagggaacctagttaactttccctaccttcctaccaaccctactaccaaaccgtacggtccctacgggaccgtacggggtccgtaaggtaacggggtacttaggggttacgggtaacccgtttaaagtttttaacgtttaaccgttcgggttaccgaacggttaaccgtttaaaggtttaaacgttttaaactttaaacccgtttacccccgttttaccccggttaaccccggggttaacccgggtttacccgggaaaccccgggtaaacggggtaaaccccgtaaagggggttaaaccggtaaaacgtaccgtaaaaaaccgggtaccgtttacggggaacggttcccggtaaccgaacccgtaacccgtacgttttcccgttaccgttttacctttaaccgtacccgtttacccccttacccggaacccctttagttacccgttaaacg

SEQ ID NO: 169410 - DNA, 1000 bp, Homo sapiens
  misc_feature: GYAE6OF01EQ3BV.37.11.A11.1.454.CMB.1.raw
  modified_base (324)..(324): a, c, t, g, unknown or other
  misc_feature (324)..(324): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgaccagtctccagacctccctggctgtgtctcgtggcgagacgggcctccatcaactgacaacgtccagccaagactttgttttaactacagtcctaccaaacaaataaacgtaactacttagtactttaggtatacagacgaacgaaaccgagggccacgtacctacctaaacgtcgtactacgtacttttacgngggtacctacgttaccggtaccccggggtaacggggttcccccgggggttacccctacgggtaacccgttagtttccggtaacgggtacgggtacggtaccggggtacccggggttaccgggttaacggggaaccttaacgggtttaccttttacccgaacccgtttaccttacccgaaacccgtaacttaaacccgaaaccgtaccggttcccgtacgggaccggtaacggggttccggtaacgggtaacggggttaacgttcgggttaacggggttaacccttttaaagtttttaaacggtttaaccgtttacggtaccgttaaacggttaccgtttaaaaggttttaaaactttaacctttaaacgtttaacccccgttcccccggtttaacgggttaacccccgggttacccgggggtaaaccccgggtaaacgggggttaaaacccgggttaaaacggggtttaaaccggtaaaaccgttaaaacccgggtaaaaccggtttaaaccgggtttccggggtttaaccgggtaaaccctttaccggggaaaccctttaacccgggtttaaccctttcgggttaacccgttttaccccgtttaaaccccttaacccggttttaccccccggttaccccggttaacccttaaacgggttttcccgtttaaaaccg

SEQ ID NO: 169411 - DNA, 537 bp, Homo sapiens
  misc_feature: GYAE6OF01DHO7E.37.11.A11.1.454.CMB.1.raw
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (528)..(528): a, c, t, g, unknown or other
  misc_feature (528)..(528): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctcatcaactgcaagtccagccagactgtttatacagctacaacaataagaactacttagcttggtatcagcaagaaaccaggcagcctacctaaactgctcatttacgtgggcatccgtacccgggagtcccgggtcctgaccgtattcaggtcggcaggcgggtctggacagtatttcactctcaccatcaacngtcctgcaggctaggaggattgnggtcttatttattactgtacagctaagttacttataactcctccgtacgtacgttcggaccgaagggaccaaggtgaaactcaaacgactggcgtactgacctacattctcgttcctactacttaccctcccacctnttcgtaacg

SEQ ID NO: 169412 - DNA, 845 bp, Homo sapiens
  misc_feature: GYAE6OF01C8M40.37.11.A11.1.454.CMB.1.raw
  modified_base (215)..(215): a, c, t, g, unknown or other
  misc_feature (215)..(215): n is a, c, g, or t
  modified_base (282)..(282): a, c, t, g, unknown or other
  misc_feature (282)..(282): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggcctcatcaactcgacaacgtccaggccagtacttgttttanacgacgtacctaccaacaaataacgtaactacgttagtcgttaggtactcgagacaacggaaaccgnggacacgtacctaccgtaactcgtacctatactttacgtggacctacgtaccgtaccgggtacggtccgggtcctaggacccgtagttccgaaggtcggacgtacgggtcggttcgtacgggtaacttacgttacgtttccgaacgtttaccgtaaccaaccctaacgtaccgtaaaccgtacggtacccgtacggaccgtacgggaccgtagggaacggtacggttcggtacgggtaccgttttaagtttacctttaaggttccgtaaccgtaagttaccggtttaaacgttaacgttttaaacttaaccgtttaacccggttccccggtttaaacccgggtaccggttttaaacccggggaaccgggtttaaaacccgggggtaaccgggtttaaaacggggtaaccggttaaaaacgttaaccccgggtaaaaccgtttaaacggttccgggtaaccgggtcctaacggaacccttaccggtactttaccggttacgttttacccgtacccgttaccgtttaccccgttaacccgtaccgttagtttaacccgtaaaccg

SEQ ID NO: 169413 - DNA, 632 bp, Homo sapiens
  misc_feature: GYAE6OF01EXLB3.37.11.A11.1.454.CMB.1.raw
  modified_base (303)..(303): a, c, t, g, unknown or other
  misc_feature (303)..(303): n is a, c, g, or t
  modified_base (558)..(558): a, c, t, g, unknown or other
  misc_feature (558)..(558): n is a, c, g, or t
  modified_base (625)..(625): a, c, t, g, unknown or other
  misc_feature (625)..(625): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagagggcctccatcaactgcaagtccagccagacttgttttactacagcctaccaaacaaataaacgaacttacttagcttggtatcagacaagaaaccgagggcagtcctacctaaactgcttactatttacgngggctagtccgtaccccggggaggttccccggggtcctacggaccgtacgttcgacggtggacgacgggtccgggtgacgggtacagttactttccacttccgtaccaaccgtactaaccaacacgccctaggcacgggtctaggaacggtatgggtggtacgttaattttacgtacgtgtactaggtactaatttaattaactacttaccctccgtacgtacgttcggaaccgtaagggaactagggaagtaanaacgaacgacgttggtcgctcgacctacgtacttcgttacgtccttatacccgttcctacccgcttntcgtaac

SEQ ID NO: 169414 - DNA, 758 bp, Homo sapiens
  misc_feature: GYAE6OF01C15AT.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagaggcctccatcaactgacaagtccagccagtacttgttttatacgagtcctaccaaacaaactaaagaaccttacttagtcttggtactcaagcaaacgaaaccgagggaccacgtaccctacctaaactgaccttctagtttacgaggggtacctaacgttcccggtacccggggtacggttccccggggttccctacggtaccctagtttccgaggtcggacgtacgggtcgggtcgtacgggaactacgttactttccactaccttcaacctacgtcaaccgtagtcctagccgaggcgttaggaggtagttcgggtacgtacgtttaactttaagttaccgttggttacctaggtaacttaagtttaacgtttaattaaaccgttaccctttcccgttaaccggtaccggtttaccgggaaccggttaaacgggtaacccgtaagggttaaacggtaaactacgtaaaaccggtaacgttcggaaccggttgtaccgacctaacccgtaacgtttcccgttacggtttaccctttaccgtaccctttacccgtttacccccgtaaccgttactttaccgtaaacccg

SEQ ID NO: 169415 - DNA, 874 bp, Homo sapiens
  misc_feature: GYAE6OF01B7SWY.37.11.A11.1.454.CMB.1.raw
  modified_base (342)..(342): a, c, t, g, unknown or other
  misc_feature (342)..(342): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccgtggctgtcgtctcgtgggcgaggacggcctccatcaactgcaacgtccacgccagtacttgttttaatacgacgtacctacccaaactaaataacgtaaaccttacgttagtcgtttaggtactacgagacaacggaaaccgacgggaccacgtacccttaaccgtaaacgtcgtcctacttactttacgngggtacctacggtcccggtacccggggtacggtccccggggtaccctacggtacccgtagtttccgagggttcggaccggtacgggtccgggttacggtacgggtaacgtacggttactttacccgaccgtttcccgtacccaaccctaacgtaacccgaaaccgtaccggtcccgtacggaccgtacggggtacgttagggacggttacggttcgggttaacggttacgtttaacgtttttaacgtaccgttggtaaccgtaacggtacgttaaagtttaactttaacttaaccgtccccgtttaaccccgttaccgggtaccggtttaacccggaacgggtaaacccggggttaacggtaaacgggttaaaggtaaaacccgtaccgtaaaaccgggttacgttaccgggttaccgggtacccttaccggaaccccttaaccgttacggttcccgtttaccgtttacccgtttacccgttaacccgtttcccccggttaacccgtacccgttaaacgttcccgttaaacg

SEQ ID NO: 169416 - DNA, 692 bp, Homo sapiens
  misc_feature: GYAE6OF01CNCFM.37.11.A11.1.454.CMB.1.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
tcagtagtgtagatcacgaccggtgctcgatttagctacgactgcagggcagcaagatggtgttgcagacccaggtcttcatttctctgttgctctggatctctggtgcctacgggacaccgtgatgacccagtctccagactccctggctgtgtctctgggcgagagggcctccgatcaactgcaagtccagccagactgtttanacngctcaacaatagaactacttagctggtatcagcagaaaccagggcagcctacctaaactgctcatttactgggcacgtcgtaacccgggacgtcccgggtccctgaccgtattcagtcgcgacgcggtctggacctaggactttccgatccgtcacctactcgaaccgagccctgacaggtcctaggacggacgtggtgggactagttttaacgttacgtgtaccagtactaaggttactttaacgtaattacccgttacccgtacccggttaaccggttaccgggtaaccctaaacgggggtaacccccgtaaaaggggttaccggttaaaacgtaccggttaaaaaacccggtaggttaccggttaaccgggaccgttaccggtaccctaacccgttaggttacccgttacggtttacccctttacccgttaccgttacccttttaccccccgggacctaaccggtttcccttaaaccggg

SEQ ID NO: 169417 - DNA, 943 bp, Homo sapiens
  misc_feature: GYAE6OF01DBQCA.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctcccgtggctgtgtctcgtgggcgaggacggcctccatacaactgacaacgtcacgaccagtactttagtttaactacgacgtacctaaccaaacaaataaacgtaacttaacgtttagtacgtttaggtactacgaacgacgaaacggaaaccggaggtaccaccgtacccttaaccgttaaacgtcgtacctacttacgtttacgacgggtacctacggtacccggtaccggggtaccggttcccgggtacccgtagtacccgtagttcgtaggtcggaccggtacgggtcgggtacggtacggtaacgtacgttacgttacgtacccgtttccaaccgtaacctaacaacccgtaaaccgtaccggtaccgtacggaccgtacgggtcggtaaggtacgggttaacgttcggtaacgggtttacgtttaacttttacggttaaccgtcgttaacaacggttaccgtttaaagtttaactttaaaccgtttaaacccgttcccctttaccccgggtttaacccggggttaacccgggttacccggggtaaaaccccgggtaaacggggttaaacccgggtaaacgggggttaaaaccctaaaaaacgggtttaccccggtaaaaacggtttaccgggttacccgggacggtttcccggtaaaccggtaacccttaacccgggtttaaacggtttcccgtttttccgggttaaaaccccttttccccttaacccccgggtttttaaccccgttaaccccggacccgttttaaacccgtttacggttaaaaccccg

SEQ ID NO: 169418 - DNA, 709 bp, Homo sapiens
  misc_feature: GYAE6OF01EZPEI.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacgggacaccgtgatgacccagtctccagactccctggctgtgtctctgggcgagagggcctccatcaactgcaagtccagccagacttgttttatacagtcctaccaaacaaataaacgaacttacttagtcgttggtatcagacaacgaaaccgagggccacgaccctacctaaactgtcctctaattttacgcgggacctacgtaccggtaaccccggggacggttacccggggtccctacggaaccgtattcgaggtcggcgacgggtccgggtcgtacgggacagttacttccaacttcctaccactacgtaccaaaccgtcgacctggacgtacgggcgtacggaggtacgttgggtacggtacgtttaaacttttacttacgttacggtctaagtacgtaagtttaatttaaaccttaacttacccgtttaccccgtacggttaccgggttaacccgggacccgtaaacggggacccggtaaagggttaacggtaaacgtaaccgtaaaacggtacgttcggtacgtaccgtacgacctactacgttcgtacttctacctacgttccctacccgacttgtccttaaacg

SEQ ID NO: 169419 - DNA, 567 bp, Homo sapiens
  misc_feature: GYAE6OF01BQATI.37.11.A11.1.454.CMB.1.raw
  modified_base (288)..(288): a, c, t, g, unknown or other
  misc_feature (288)..(288): n is a, c, g, or t
  modified_base (388)..(388): a, c, t, g, unknown or other
  misc_feature (388)..(388): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgttttatacagctaccaaacaataagaactacttagcttggtatcagcaagaaaccaggcagcctactaaactgctctatttacgnggcacgtccgtacccgggacgtcccggggtccctggaccgtattcgaggtggcgaggtcggtcgtgggactaggtacttcactctaccacctatcaaacncgcctgcaggctaggaggtatggtgtctaatttactacgtgtacagctagtattaatacttacctccgtcgtacgttaccggaccgaacgggtacctaaggtacgaaactacgaaacgtatgtcgtactgaccactattccgtagttccttactacgtcccttaccgcttagtcgtacg

SEQ ID NO: 169420 - DNA, 995 bp, Homo sapiens
  misc_feature: GYAE6OF01AZL1J.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtctccagacctcctggctgtcgtctcgtgggacgaggacggtcctccatcaactgactaacgtccacgccaagtactttagttttaactacgacgtacctaaccaaaactaaattaaacgtaaccttacgttttacgtcgttttaggtaactaccgaaggaaccgaaacggtaaaacccggaggggtacctaaccgttaaccccgttaaccgttaaaaccgtcggtaccttacgttaacgttttaccggaccggggtaccttaaccggttaccccggggttaacccccgggggtaccggggtttacccccggggtacccgttaaccgggtaaccccggtagttttacccgggtagggttaaccgggtccggtaaccggggtccccggggtttacgggtaacggggttaaccgtaacgggtttaacctttttacccgaccccggtttaacccctacccggtaaaccctttaaacgtaacccgtaaaacccgtccggttaccccggttaacgggaccgggtaaccggtacgggttaacggggtaacgggttacgggtttaccggttacggggttaacgtttttaaacgttttacgtttaaaccggtccgttaacggtaccgtttaacgttaaacgtttaacgtttaacttaaaccgttcccgttaacccggtttacggtaacccggtttaacccggaaccgggtaacgggtaaaccgggtaaacggttaacgaaaacgtaaccggtaaacgtacggttacgggtacggtaccgtaccgtccggttaataccggttccttaccgttactttacccgttacccttaccccgttaacctacccgttattaccggttaaaccg

SEQ ID NO: 169421 - DNA, 614 bp, Homo sapiens
  misc_feature: GYAE6OF01A0CB3.37.11.A11.1.454.CMB.1.raw
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
  modified_base (393)..(393): a, c, t, g, unknown or other
  misc_feature (393)..(393): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctcatcaactgcaagtccagccagactgttttanacagctacaacaataagaactacttagcttggtatcagacaagaaaccgngggcagcctacctaaactcgctctatttacgngggacacgttccgtacccgggaggtcccggggtcctaggaccgtattcgaggtggcaggtcgggtctagggacagtacttcactctacaccatccaactcgccngaccgaggtctagacggtatgggtcggtacttatttacgttacgtgtacgagtactaagttattactaacttacctacccgttcggtaccggttccggaccgtaagggtaccgtaagggtacggtaaactacgaaacgtacgtggtaggtaccgtacgcctaacgtagttccgtacgttccttaccgtaccttcccgttaccccgacttacgttctaacgg

SEQ ID NO: 169422 - DNA, 686 bp, Homo sapiens
  misc_feature: GYAE6OF01A1KLD.37.11.A11.1.454.CMB.1.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacggcctcatcaactgcaagtccagccagtacttgttttanacagctaccaaacaataagaactacttagctttaggtatcagacaaggaaaccgagggcacgacctacctaaactgtctactatttacgngggactacgtaccggtacccgggtaggttcccggggtacctaggtaccgtattcgaggtggcgacggtcgggtcgtagggactagtacttccgactcctacgactactaccgaactcgtacctgacgtaggcgtggaaggtgttacgggtgtacttaagttttacgtacgtcgtacgtagtacttaagttacttaataaccgttaccgtacccgttaccggtaccggtttaccggaaccggtaaacggggtaaccgtaaagggttaacgtaaactaaccggtaaacgtacggttacggtacggtacgtaccgaccgtaacctacgtttcgtaacccgtttcttaccgtaccgtttacccgttaccccgacttacgttccgtaaacg

SEQ ID NO: 169423 - DNA, 744 bp, Homo sapiens
  misc_feature: GYAE6OF01B0SO6.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagaggcctccatcaactgcaagtccagccagactgtttanacagctaccaacaataagaacttacttagctttggtatcgagacgaacgaaacgaggacagaccctacctaaactgtccgtctaacgtttacgtacgggtcacgttacccgtaacccgggtcggttccccggggttccctacggtaaccggtactttaccgaggttcggaccgtacggtcgggttacgtacgggacgtaacggttactttacctaaccgttcctaccaaccttaactaacccgtaaaacctaccggtacccgtacgtacccggaacgggtaccgttagggtaaacgggtacggttaggtacggggttaacccgtttaaagtttttaccgttaaaccgtttcgtacgtaacggtacctaaggtttaaatttaacgtaaactttaccgtaccccgttaccggtaccgttaaccgggaccggtaaacggtaccgtaaaggtacgaacgtaacgaacgtacgtagtcgacgtacgtaccacgtaacttccgtattaccttacgacttaccgttacccgctcgttctaaccg

SEQ ID NO: 169424 - DNA, 673 bp, Homo sapiens
  misc_feature: GYAE6OF01BE80N.37.11.A11.1.454.CMB.1.raw
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagactccctggctgtgtctcgtgggcgagagggcctccatcaactgacaagtccagccagtacttgttttanacagcctaccaaactaataacgaacttacttagtcttaggtatcagacaacgaaaccgagggcacgaccctacctaaactgctactattacgnggacacgtcggtacccgggaggttcccgggtacctggacctagttacgaggtcggaccgtggtcggtcgtaggactagttacttccactcacctaccactacaacgacgccgtagcgagtcgtagaggtagtggtagcgttaatttacgtactgtacaggtactaagttattaactacctcctaccgtccggtaacgttacccggaaccggtaacgggaaccggtaaaggtaacgtaaaccgtacgtaaacccggtagtaccggtacggtcgtaccgaacctaacccgttctacccggtttacgttacccctttaacgttacccgtttaccccgttaccccgcgttaaaccgttacgttaaacccg

SEQ ID NO: 169425 - DNA, 707 bp, Homo sapiens
  misc_feature: GYAE6OF01C7NRH.37.11.A11.1.454.CMB.1.raw
  modified_base (417)..(417): a, c, t, g, unknown or other
  misc_feature (417)..(417): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtggatcgaccccagtcctccgagacctcccgtggctgtgtctcgtgggacgagcggcctccatcaactgacaacgtccacgcctagtactttagttttaacacacgtacctaaccaaactaaagtaaacgtaaccttacttacggtacgtttaggtaactacgaacggacgaaacggaaacccggagggaccaaccgtacccttaacctaaacgtcgtacctacttagtttaccgacgggacctaacggtcccggtaaccgggtacggtacccgggtcctacggtaccgtnttacggaggtcggacgacgggtcgggtcgaggtactacgttacttcactctacgaactctacgaactgtccgagacgtaggacgtaggaacgtgttaggtacggtaactttactttagtacgtgacctacggtaataagttaactttaacgtactaccgtccgtaccgtacggtaccgaaccggtaaggacgtaagtacgaaacgtacaaacggtgttcgacggacttacgacctactacgttcgttaccttactacgtaccttcccggtaccactcgttacgtaacccg

SEQ ID NO: 169426 - DNA, 655 bp, Homo sapiens
  misc_feature: GYAE6OF01EY504.37.11.A11.1.454.CMB.1.raw
  modified_base (222)..(222): a, c, t, g, unknown or other
  misc_feature (222)..(222): n is a, c, g, or t
  modified_base (291)..(291): a, c, t, g, unknown or other
  misc_feature (291)..(291): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaanaataagaactacttagcttggtatcagcaagaaaccagggcagcctacctaaactgctctaatttacgngggctatccggtacccggggacggtcccggggtccctggaccgtattcgaggtcggcgaggccgggtcgtacggaacctagtactttccgactcctaccaccataccaacagcctgcgaggctaggaggatggtggacgttaatttacgtactgtctagacgtaattaattaataactacccttccgtaccggtacgttaccggaaccgtaaacgggtaccgtaaagggttacgtaaaactaccggaaaaacgtacgtagggtaccggtacctacggaccctaaccgtaacgtttccgttacggttaccctttaaccgtaacccgtttccccgttacccccgaccttaccgttacgttaaaccg

SEQ ID NO: 169427 - DNA, 735 bp, Homo sapiens
  misc_feature: GYAE6OF01D7S2Q.37.11.A11.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (347)..(347): a, c, t, g, unknown or other
  misc_feature (347)..(347): n is a, c, g, or t
  modified_base (664)..(664): a, c, t, g, unknown or other
  misc_feature (664)..(664): n is a, c, g, or t
tcagtagtgtagatcacgaccggtgctcgatttagctacgactgcaggggcagcaagatggtgttgcacgacccaggtcttcatttctctgttgctctggatctctggtgaccgtacgggacaccgtgatcggacccagtcctccacgacctcccgtgtctgtcgtctcgtgggcgaggacggcctcanacaactgactaacnccgaatccgagtacttgtttaacacagaccctaacaactaaataaanaaccttatagtacttagtacacgacgaccaaacgaaccgtaggacctaacgaccctaacgtaaactcgtactacctaaaggtttcggacggtaaccnccgttacccgggtacccggggtaccggttccccggtaccgttaccgaacgttacgttacggcgggtgaaccgggtcgggtaccggtacggtaacggaccgtaagtttacctccaccttaccaccaactaacgtaaccaaaccggtcgtacgcgtacccgtaagggtgtaaaggtaggtggtacggttagtaacgtttatttaccggtatcgaacgtagttgtaattaacttacgttaaccttccgacgttaacgtccgacgtaaccgggaacgtaacggtaacgtaagaaacgaacccaaggttaccggtgtaaccncgtaagtaccgtacttcggtcctttacgttacaccgtttcccaacgttaccccaggtacttacgttacccg

SEQ ID NO: 169428 - DNA, 773 bp, Homo sapiens
  misc_feature: GYAE6OF01AO3MS.37.11.A11.1.454.CMB.1.raw
  modified_base (710)..(710): a, c, t, g, unknown or other
  misc_feature (710)..(710): n is a, c, g, or t
tcagtagtgtagatcacgaccggtgctcgatttagctacgactgcaggggcagcaagatgatgttgcagacccaggtcttcatttctctgttgctctggatctctggtcgccgtacggggacacgtgatcgaccagtctccagactccgtgctgtgtctcgtgggcgagacgggcctccatacactgactaacgtccgagaccagtacttagttttacgacacgtacctaccaaactaaactaacgtaactacgtttagtaccgtttaggtactaccgacgaaccgaaaccggaaaaccgtacgggtactaaccgtacccttaaccctttaaacgtccgttacttaaccgtttaacttttacgggtaccggtaccgtaccgttacccgggttaccccgggggaacggtttcccggggtaccctcggaaccgtacttcggtacggtcggacgtcggtacggggtcgtaggactacgttactttaccgactacctacaacccgtatacgaaccgtcgaccgttgacgcggtagttcgaggtagtcggttacggtactttagtttacgttacgttcgtacgtattaacgttaagtttaaattacgttaacccttccgtttaccgtaccggttaaccggttccggaaaccggttaacgggtaacgttaacgggtaagtaaacgtaaaccgaacggttacgtaccggcgtaaccncgtaaccgtacgttattccgttacgttaccgttacttacccgtaactccccgattacctaacg

SEQ ID NO: 169429 - DNA, 802 bp, Homo sapiens
  misc_feature: GYAE6OF01B08IF.37.11.A11.1.454.CMB.1.raw
  modified_base (581)..(581): a, c, t, g, unknown or other
  misc_feature (581)..(581): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctcagacctccgtggctgtgtctcgtgggcgagacggcctcatacaactgacaacgtccaggaccaaggtactttgttttaacacgacgtacctaaccaaaactaaactaaaggaaccttacgtttaacggtctttaggtaatacgaacgaccaaacggaaaccgaggggaccaacggtccctaaccgtaagcgttggtaccttcggttttaccgaccgggtccttacccggtaaccggggtaaccgttcccggggtaccctaaggaaccgttacgttacggtacgggtcggggtaccggggcgggttacggtacgggtaacgtaacgttactttaccgaccttaccgtacccaactacacgaacggtcgtaaccggccggttacgggaccggtattaacgggaaggttagttgggttaacgggtttacgtttaacgttacgngtaacgtacggtattagtttaacgtttaacgttcgttaaccttcctaacgttacggtttacgggtttacggaccgggtaacgggaccgtaaagggtccgaacgggtacgtaacgtaccggtaaccggtaagtaacccggtgggtaccgttaccgacggtactaaccgtcgttcgttacggttacccttacgtaccctttcccgacccgtactcgttaaccg

SEQ ID NO: 169430 - DNA, 789 bp, Homo sapiens
  misc_feature: GYAE6OF01ATCXF.37.11.A11.1.454.CMB.1.raw
  modified_base (224)..(224): a, c, t, g, unknown or other
  misc_feature (224)..(224): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctccagacctcccgtggctgtcgtctcgtgggcgaggcggcctaccataccaacgtgacacgtccagccagtactttgttttaanacgacgtacctaccaaaactaaataactaacgtttacttagtcgtttaggtactacgacgaaccgaaacggaaaccggacgggaccaccgtaacccgttaacctaaacgtcgtaccttaccgttacgtttacgggacggtaccttaaccggttcccgggtaacccgggggtaaccgggttcccggggtaccctacggtaaccggttacgtacggacgggttcggaccgtacgggtccgggttaggacggtactagttacctttccaccgtttaccaaccgtaaccctagtaacccgaaccgtcggtaaccgtgggaaccgtagggtacgtagggtacgtcgtaggttccggtacgtttaacgtttacgtacgttagtacgtacgttataacgttaatttacttaacgttcccgtaaccgttccgggtaccggttaaccggaaccggtaacggtaccgtaagttaaccgaaacgtaaccgaacgttcggaggtaccgacgtaccgaccttaactcgttcgtaccttcttaccgacccgtttcgtaccccgacgttcttcggtaaac

SEQ ID NO: 169431 - DNA, 884 bp, Homo sapiens
  misc_feature: GYAE6OF01AE44K.37.11.A11.1.454.CMB.1.raw
tcagtagtgtagatcacgaccggtgctcgatttagctacgactgcaggggcagcaagatggtgttgcagaccaggtcttcatttctctgttgctctggatctcgtggtgccgtacggggactaccgtgatcgaccagtctaccagacctccgtggctgtcgtctcgtgggcgaggacgggtcctccataccaacgtcgacgaacgtcacggtaccaaggtacctttagttttaacacacgtactaccaaaacaaagttaaacgaaccttacggtacgcgtttcggtaataccgagaacgaaacggaacccgagggacctaacgacccttaacgtaaacgttcacttacttaagttacggtggacctacgtacccggtaccgggtacgggttcccgggtaccctaggaaccttacgggttacacgggttcggacccggagggtccgggtacggttaacgggacctaaaagttcgttaccgtaacctacccggtaacaaccctaaagtaacccgtaaacccggtacgtacccggtacgtaaaccgggcgggttaacggttacggaacggttacggggttaacccggttaacggggtttaaactttaacgttttaccggttaaacgtttaccggtaccggggtaaatttacttaaaagggtttacctttaaacgtaaaccgttacccgttaacccgtttaccgggtaaccgtttaaccggggaaaccgtaaaccgggtaaccgaaaggggttaaacctaaacggtaaccgtaacgtaacgggttacgtaaccggtcgttaaccggtacctaacccggtaacgtttcaccgtttaccggtttacccactttaccccccggaattacccgtacggttacccttaaacgg

SEQ ID NO: 169432 - DNA, 681 bp, Homo sapiens
  misc_feature: GYAE6OF01EALFI.37.11.A11.1.454.CMB.1.raw
  modified_base (161)..(161): a, c, t, g, unknown or other
  misc_feature (161)..(161): n is a, c, g, or t
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (637)..(637): a, c, t, g, unknown or other
  misc_feature (637)..(637): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctntgggcgagaggcctccatcaactgcaagtccagccagtacttgttttaanacacgcctaccaaanaataaagaactacttagacttggtancagcaacgaaacgngggcagtcctactaaactgactntagtttactgggcctagtccgtacccggggtacggtcccggggtccctcggtactagtttccgagtggacnggcggtcgnggaactgtattcgacttcacacataccgaaactgaccgtgacgtacggtccttagggaggtagtggttacgggtaccgttaattttaagttacgtcggtactagtaccgtaagtttaatttaactttaacgttacccttacccgtaccgggtttaacccggttacccgggacccggtaaaacggggtacccgtaaagggttaacggtaaaacttaacccgaaaggtacccggtagtccgggaactcggacctaaccggtcttacgttnttaaccccttcgtacctttcccgaacccctcgtacttcggtaac

SEQ ID NO: 169433 - DNA, 677 bp, Homo sapiens
  misc_feature: GYAE6OF01C4KC5.37.11.A11.1.454.CMB.1.raw
  modified_base (171)..(171): a, c, t, g, unknown or other
  misc_feature (171)..(171): n is a, c, g, or t
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactcctggctgtgtctcgtgggcgaggngggcctcatcaactgcaagccagccagtacttgtttaanacgagcctacaaacaaataaagtaactacttagcttggtatcgagcaacgaaacgngggacacgcctacctaaactcgctctatttaccgnggacacgtccgtaccgggacgtcccggggtcctagaccgtagttcgaggtcggacgacggtcgggtcgtacgggactagtacttcactctcacagtaccaacacgccgtagcgacggcgttaggaggtagttgggtacggtattaacgttttaacgtacgttgtacctagggtaccttaaggttaaatttaactaaacgttacccgttacccgtaccggttaccgggttacccggtaaccggaaaggggtaacccgaaagggttaacggaaaactacgaaaaccggtacttaggacggtactacgaccgtaccctaagttccgttacgtttcccgttaacctacggtttacccctccggtaacttctggttaaacc

SEQ ID NO: 169434 - DNA, 674 bp, Homo sapiens
  misc_feature: GYAE6OF01BAVXD.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataacgaactacttagcttggtatcagacaagaaaccgagggacacgcctacctaacgctcggtccttacgtttacgtcgggtcctccgtacccgggtaacgtcccggggtccctagaacgtattcgaggtcgggcgggtcgggtcgtagggactacgtactttacgacctcctaccaccctacgtcacggtccgaacgtcccggtcgggccgggtacgtaggaaaggtcgtttaggttcggggttacggtttttattacgtcggtactaggtactagttaatttacgtaaacttcccgtcccgtaccggttacggttaccgggaaccgaaacgggtaaccgtaaggtacggaaactaccgaaacgtacgtggtcggctagaccaccgtagtccgttcgtactttccgaccttcccgttaccccgacttcgttaccgtactacttcctaaccg

SEQ ID NO: 169435 - DNA, 794 bp, Homo sapiens
  misc_feature: GYAE6OF01B196E.37.11.A11.1.454.CMB.1.raw
  modified_base (167)..(167): a, c, t, g, unknown or other
  misc_feature (167)..(167): n is a, c, g, or t
  modified_base (758)..(758): a, c, t, g, unknown or other
  misc_feature (758)..(758): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctccagactccctggctgtgtctctggcgagnggcctccatcactgcaagtccacgccagtacttgttttaatacagacctacccaaacgaataaacggaaccttaacttacggtctttaggtactacgtacgaccaaacggaaaaccgagggacctaacggtacccttaacctaaacgtcgtacctacgttaacgtttaaccgtacgggaccttacgtacccggtaaccccggggtacgggttccccggggttacccgtaccggtaccgttacgttcgacggtcgacggtacgggtaccggtcggtacgaacgtaacgttcttaccgtactccgtaccacctaacgttacgaacgtacgtaccgtacggtacgtacgggtacgggtaagtcgggtaacttaggggtaccgttaaacgttttattttaacgtcggtacccgtagtaacgttacgttaaagtttaacttaaccgtaaacctttcccggttaccgtccggttacccggttaacggaaccggtaacgggtaaacggttaacggaactaaaccgttaaccggaaacgttcgggtaagtccgggacgttaccaaacccgttcgttaaaccgttcggttacgttacccngttaccccttacccgtccacttaacgtccttaaacg

SEQ ID NO: 169436 - DNA, 846 bp, Homo sapiens
  misc_feature: GYAE6OF01CZO6Z.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctccagacctccctggctgtgtctcgtgggcgagacggcctccatacaactgacaacgtccagaccagtacttagttttactaacacgacctaccaaacaaactaaacgtaacttaacttagtacgtttaggtactacgaagtaccaaacggaaaacccggaggggaccaaccgtaccccttaaccttaaaacgtcgtaccttacgttaacgttttacggtacggggtacctaacgtaccccggtacccgggggtaccggttccccgggggttccctaggtacccgtagtttaccggacggttcgggacggtacgggtccgggtacggtacgggtaactacggttactttacccaccgttacctaccacctaacgtacccgaaacacggtcccgtacggacgtacgggtacgtgggaaggttacgttggggtacggtacgttttaagtttttaactacccggtgttacgagttacgttaagttaactttaacctaacgttacccctaccggttaccggttaacggttaccggaaaccggtaacggtaccggtaaagggttaaccgaaacgtacgaaaccggttacgtgggtaaaccggtcccttaacggaccccttaaaccgttcgtttaaccccggtttacgttaccctttaaccgttaccccgtttaacccccgttacccgaaccgttacggttacctaaaaccg

SEQ ID NO: 169437 - DNA, 798 bp, Homo sapiens
  misc_feature: GYAE6OF01EQ1NK.37.11.A11.1.454.CMB.1.raw
  modified_base (472)..(472): a, c, t, g, unknown or other
  misc_feature (472)..(472): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatcgacccagtctcagactcctggctgtgtctcgtgggcgaggacggcctcatacaactgacaagtccagccagtacttgtttaacacacgactaccaaactaaagtaagaacttacttagcttaggtatcagacaagaacgaggactacgacctacgtaaactcgacttactaactttacgcggactacggttaccggtacccggggaccggttccccggggtaccctacggtaaccgtacgtttcgacggttcggaccgtacggtcgggtcgttacgggactaagtactttacgactccgtaaccacctaagtaccaaacgtcgtacgtacggacgaacggttntaacgggtaggtacgttgggtacggttactttaaagttttacttacggtacgttacgtaacgtacgttaaacggtttaaatttaaacgtaccctttaacccggttaccccgttaacccgggtaaccggggtttaacccggaaacccgggtaaaaggggtaaaccccgttaaaaagggtaaccgtaaaaccgttaaacccggtaaaaaccggttggttaaccgtcgggtaactacccgtaacccgtaaattaaccggtttactccggtttaacccttaccgttacccgttacccgttacccccgtaacctaagttcccttaaaacgg

SEQ ID NO: 169438 - DNA, 866 bp, Homo sapiens
  misc_feature: GYAE6OF01A1JED.37.11.A11.1.454.CMB.1.raw
  modified_base (323)..(323): a, c, t, g, unknown or other
  misc_feature (323)..(323): n is a, c, g, or t
tcagtagtgtagatcacgaccggtgctcgatttagctacgactgcaggggcagcaagatggtgttgcagacccaggtcttcatttctctgttgctctggactctctggtgccgtacggggacaccgtgactcgacccagtcctaccgagacctcccgtggcttggtcgttccgtcggtggggcgaggcgggcctaccatcaacgtcgactaacgtccagaccgtagtacctttagttttaacacgacgtacctaaccaaactaaactaaacggtaacttacgttacggtcgtttaggtactacgacgtacaaacggaaaccgngggaccacgtaccctaactaactcgtacctagttacgttacggcggactacgttcccgggtaacccggtaccgggttcccgggtacctacgggaaccgttcgttacgggcggttacggaccggtacgggccgggtttacgcgggtaccgtattaccgttcccacgttccctactaaccgtaactacccgaaccggtcgtccgacggtacgtacggttacgacgggttaggtcgtcgggttacgtacgtttaacgtttactacggtttcgtaacgtaccggttacttaaacgggtttaactttaacgtaccgttacccgttacccgttacccgggtaaccgggtttaacccgggaaaccggtaacggggtaacccggttaaacgggtaaaccgggtaaacgttaaacccgggtaaacggtaacggtacccggggttaccggtacctacccggtaaacccttaacggtacccttttcggtaccccggtttaacttaccgggttaccccttcccgtttaacccgacgttaccgtacccgttaaacg

SEQ ID NO: 169439 - DNA, 548 bp, Homo sapiens
  misc_feature: GYAE6OF01DLW0V.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagactgttttanacagctaccaacaataagaactacttagcttggtatcagcaagaaaccagggcagccctacctaaactcgctctatttactgggcagtccgtacccgggagtcccggggtcctgaccgattcgagtcggcaggcggtctggacagtatttcactctacaccatcaacgcgcctgacaggctaggaggagtgtggactatttaattactgtacagtctagtattataatacctccgtacgacgttcggaccgaagggacaaggtacgaaatcgaaaacgacgttggcggctacggactacctattcgtcgtcttactacttccctaccgccagttcgtaacg

SEQ ID NO: 169440 - DNA, 704 bp, Homo sapiens
  misc_feature: GYAE6OF01DUR5Y.37.11.A11.1.454.CMB.1.raw
tcagtagtgtagatcacgaccggtgctcgatttagctacgactgcagggcagcaagatggtgttgcagacccaggtcttcatttctctgttgctctggatctctggtcgccgtacggggacaccgtgactcgaccctagtcctcccagaccttcccgtggcttggtcgtctgtgggcgaggcggtcctccatacaactgcaagtccagccagtacttagtttaacacagacctacaaactaataacgtaactacttagtcttaggtactcgaacgacgtaaacgaaaccgagggacctaccgtacccttaactaaacgtcgtacttcttaacgtttacggcggtacctacgttacccgggtacccgggtacggttccccgggtacctacggtaccgtagttccgaggtcggacgtagggtccgggtcgtacggaactattacgttacctaccgtactacccgaactaacgtacgaaccgccgttacggacgacggtacggtcgtacggagtagttgtaacggtacgtttatttacgtacgcgtacgattactaagttaactttaactaccgtaccgttcccgtacggtaccggtaccgaaacggacggtacgtaaggtataaacgtacgtaacgtcgttgaccggtacaccgtacctaacgtcttccgttactcgttactacctccgtcccaatcgtcgtaacg

SEQ ID NO: 169441 - DNA, 903 bp, Homo sapiens
  misc_feature: GYAE6OF01BM1V7.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacggcctccatcaactgacaacgtccagccagtacttgttttatacagtcctaccaaactaaataacgaacttacttacgtcgtttaggtactcagacaacgaaaccgagggacacgtacctaaccttaaacgttcgttactaacgttttacgcgggtactacgttacccggtaccccggggtacggttccccggggtccctacggtaccgtacttaccgacggtcgggaccgtacgggtccggggtaccgtacggggtaactacggttactttaccgaccttcctaacccgacccgtaacttaacccgaaacctacggtcccgttacggccgtaacgggtacgtagggtaacgggttagtaccggggttacgggtaacgtttaaacgtttttaccggttaacgttacgggttaaccgttaacgggttacgttaaacgggttttaaacttttaaaccgttaaaccgtttaccccggtttaccccggttaacccgggtttaacccgggtttaacccggggaacccgggttaaaaccgggggttaaccgttaaaacgggggtttaaacgtaaaaccggtaacccggttaaaaaccggtaaccggttcgggttaccgggtaccgtttacggaaccccgttacgttaacccgtttacgttaacccggtttccttaacccggttaccgttttcccccgttaccccggacctttacgttaacccgttacggttaaaaccc

SEQ ID NO: 169442 - DNA, 683 bp, Homo sapiens
  misc_feature: GYAE6OF01CNHC7.37.11.A11.1.454.CMB.1.raw
  modified_base (221)..(221): a, c, t, g, unknown or other
  misc_feature (221)..(221): n is a, c, g, or t
  modified_base (669)..(669): a, c, t, g, unknown or other
  misc_feature (669)..(669): n is a, c, g, or t
tcagtagtgtagatcacgaccggtgctcgatttagctacgactgcaggggcagcaagatggtgttgcagacccaggtcttcatttctctgttgctctggactctctggtcgccgtacggggacacgtgatcgacccagtctccagaccttcccgtggcttgtgtctcgtgggcgaggacggcctccatacaacgtgcaagtccagctagtactttgtttanacgacgtcctaccaaataaactaacgtacttaacgttgcttaggtactcagacaacggaaccgagggaccacggtacccttaacctaactcgacttacgtagttacggtggactacgtccgggtaccgggtacggtcccgggttccgtacgaccgtacgttcgtaggcggacggtacggtcgggttacgtaggaactacgtacgttactacctacgtaccacctaacgtacccgaacgtacggtaccgtcggacgtaggtacgttacgggtagtaacgtggttacggtacgtttaagtttctaacgtcgtacgtagtacgttaagttattaacgttacttccgttaccgtaccggtacgttaccggacgtaaggtacgtaaggtaacgtaacgacgtaaacgcgtgacgtctcgtacctatacgttcttcgtacttacgtccttaccncctcgtactcgtac

SEQ ID NO: 169443 - DNA, 777 bp, Homo sapiens
  misc_feature: GYAE6OF01AW9TC.37.11.A11.1.454.CMB.1.raw
  modified_base (212)..(212): a, c, t, g, unknown or other
  misc_feature (212)..(212): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgacaagtccagccagacttgttttaanacagctaccaaacaaataagaactacttagcttggtatcagacaagaaaccgagggacacggaccctacctaaaactcgtactactagttttacaggggacacgtccgtaaccccggggtacggttcccgggggtcccttaggaacccgtatttaccgaaggttcggacgacgggcgggttaccgtggggaaccaggtaactttccaccttcctaccaaccgtaactccaaaaccgtacgtcccgttcgaccgagggtaccgttaggaaggtacgttagggttagggtacccgtttaaagtttttaagtttaaccgtaggtaccgtaaacggtaccgtaaacgttttaatttaacggttaaaactttacccttaccccgtttacccggtaaccgggttttaccggaaccccggtaaaacgggggtaaccccgttaaagggtaaccggtaaaactaaccgtaaaaccgtacgttacggtacggtaccgtaacggacctaaaccgtacttccgttacgtttaccttaccgtacttacccgttaccccctaccgttaatccgtaaacg

SEQ ID NO: 169444 - DNA, 821 bp, Homo sapiens
  misc_feature: GYAE6OF01BYQL3.37.11.A11.1.454.CMB.1.raw
  modified_base (269)..(269): a, c, t, g, unknown or other
  misc_feature (269)..(269): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagtacttgtttatacagtcctaccaaacaataacgaacttacttagtcttaggtatcgagacaacggaaaccgngggtctacgacccttacctaaactcgaccttactatttacgtgggacctaacgttacccgtaccccgggggtacggtccccggggttaccctcgggaacccgtatttaccggaggttcgggaccgtacggggtccggggttacgtcggggtaacctagttacctttacccgaacctttccccgtaacctaaccctaacgttacccgaaacccgtacggtccccgtacggacggtaaccgggtccgtaggggaacggtaggttcgggtacggttaaccgtttaatttttaacgtaccggttcggtactaaggtaccttaaggtttaaactttaacgttaaacccttaccctttacccgggttaaccccggttacgggtttaacccgggacccggtaaaaccggggtacgttaaaacgggggtaacgtaaaccgtaccgtaaaaacccgggtcgttacggtacggaccggttacgaccctaaaccggttcttacgttacccgttactttacccgttacttcccccttaccccggacttaacgttccgttaaacg

SEQ ID NO: 169445 - DNA, 777 bp, Homo sapiens
  misc_feature: GYAE6OF01C1IYN.37.11.A11.1.454.CMB.1.raw
  modified_base (138)..(138): a, c, t, g, unknown or other
  misc_feature (138)..(138): n is a, c, g, or t
  modified_base (168)..(168): a, c, t, g, unknown or other
  misc_feature (168)..(168): n is a, c, g, or t
  modified_base (297)..(297): a, c, t, g, unknown or other
  misc_feature (297)..(297): n is a, c, g, or t
  modified_base (565)..(565): a, c, t, g, unknown or other
  misc_feature (565)..(565): n is a, c, g, or t
  modified_base (682)..(682): a, c, t, g, unknown or other
  misc_feature (682)..(682): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgactgaacccngtctccagacctcccgtgctgtcgtctcgngggcgagacgggcctccagtacaactgacaacgtccagacctagacttgtttactacacgacctaacaaacaaagtaacgtaacttacgtttagcgtttaggttacacgaacgaccaaacggaaaccgngggtaccaacgtacccttaaccgtaaacgtcgtcctacgttacgtttacgacggactacggtacccggtaccgggtacggttccccggggtccctaggaaccgttacgtttcgaacgggtcgaaccgggttacgggtccgggttcggtacgggtaacttaacggttacttacctacctaaccgtaccgaactacgtacaaacgcggtctacgcgtacggtactacgggagttagttcggcggttaacctttatttacttaccggttancgtaacggttacctaagttaaatacctttaaacgtacccgtaccggttacggtaacccgttacgggaacccggtaaggttaacccgaagggtttaacgaaactaccggtaaaacggntttaccggaccggttataacccggaccttaacgttaccgtcgtttcccttacgttaaccgtacctttaccccggcctaactaggttactaacccg

SEQ ID NO: 169446 - DNA, 705 bp, Homo sapiens
  misc_feature: GYAE6OF01CXS3E.37.11.A11.1.454.CMB.1.raw
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (608)..(608): a, c, t, g, unknown or other
  misc_feature (608)..(608): n is a, c, g, or t
  modified_base (636)..(636): a, c, t, g, unknown or other
  misc_feature (636)..(636): n is a, c, g, or t
tcagtagtgtagatcacgaccggtgctcgatttagctacgactgcgagggcagcaagatggtgtgcagacccaggtcttcatttctctgttgctctggatctcgtggtcgccgtacgggacaccgtgactgaccctagtctaccagacctccgtgggctggtcgtctcgtggggaccgaaggcgggtccctacgatacgaaacgtcgaccgtaacggtccaacggccctaaggtaccgtttgttttaacaccaggtaccctaacgaaaactaagtaaacgtaactaccgttaggctttaggtacncgaacgacgaacgaacggcggactacgccctaacgtaatcgctatacgttacgcggctacgtccgtaccggcgtccggtctacggtactcgtgagtcgacncggtacgtgagtacngttactccacgtcaccagtactacgacngtcncggtacgagcgtagagtacgagtacggtagttacttaacgtgtacggtactacggtaataacgttaactaccgttaactaccttacccgtaccggttcggttaacgaaccggtaaacggtaccgaaacggttaacgaacgtaacgtaaaccggtntacgggtacgtaccggacgttaacccgntaacgtttccgttaccgtacgtttaaccgcgttttacccgccccgtaaacttcgggtaacccttaacgg

SEQ ID NO: 169447 - DNA, 824 bp, Homo sapiens
  misc_feature: GYAE6OF01EF26E.37.11.A11.1.454.CMB.1.raw
  modified_base (728)..(728): a, c, t, g, unknown or other
  misc_feature (728)..(728): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccctggctgtgtctcgtgggcgagacggccctaccatcaacgtgactaacgtccacgccaagtactttgttttaacacgacgtacctaccaaaacaaattaaacgtaaccttaacgttacggtacgtttaggtactacgaacgaacgaaacgaaaaccgacgggacctaccgtaccctaacctaaacgtcgaccttaccttaacgttttacggacgggaccttaccggtacccgggtaaccccggggtaccgggttccccggggtccctacggaccgttcgtaccggaggttcgggaccgttacgggtccggggtacggtacggtaacgttacgttaacctttcccacctttaacccgacctaaccctacgttaaccaaaccgcggtcctaacggaccggtacggtcgttaggacgggttacgtaggttaccgggttaatttaacgtttacgttacgtacggtacgtaagtaacgttaagtttaacttaagtaccctaccgttcctaaccgggtacgttacggggaaaccgtaacgggtacgtaaagggtaactaaccgttaaacgacgttaaccgggtntaccggtactaccggtaaccttaccggttactttccgttacggttaaccttccgttaaccgttaccccgtcccgtaaatttccgacggttaaaccc

SEQ ID NO: 169448 - DNA, 678 bp, Homo sapiens
  misc_feature: GYAE6OF01D4MCW.37.11.A11.1.454.CMB.1.raw
  modified_base (508)..(508): a, c, t, g, unknown or other
  misc_feature (508)..(508): n is a, c, g, or t
  modified_base (667)..(667): a, c, t, g, unknown or other
  misc_feature (667)..(667): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagacgggcctccatcaactgcaacgtccacgccagtacttgttttacacacgcctaccaaactaagtaaacgtaacttacttagtcgttagtatacgagacgaacgaaaccgacggaccaccgtaccctaactaaactcgtcttactacgtttacgtggactacgtaccggtacccggggtacggtcccgggtaccgtcggtacgtattccgaggtcggacgtacggtcggtcgtacggactagtcttcgactcgtaccacgtactaccgaaacgcgtcgacggtacacgggtacgtacggtaggtacgttgggtcggtacctttaagtttacgttacgngtagaacggtactttaagttaactttaacgtcgttaccccgtccggtaccggtcgtaaccggaaccggtaacggtaacggtaagttaacgaaccgtacgtaaacgcgttcgccggtactcggaccctattgtcttacgttacgttcttcctaccgttanctcgtcttacg

SEQ ID NO: 169449 - DNA, 575 bp, Homo sapiens
  misc_feature: GYAE6OF01CVXKJ.37.11.A11.1.454.CMB.1.raw
  modified_base (133)..(133): a, c, t, g, unknown or other
  misc_feature (133)..(133): n is a, c, g, or t
  modified_base (137)..(137): a, c, t, g, unknown or other
  misc_feature (137)..(137): n is a, c, g, or t
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (210)..(211): a, c, t, g, unknown or other
  misc_feature (210)..(211): n is a, c, g, or t
  modified_base (237)..(237): a, c, t, g, unknown or other
  misc_feature (237)..(237): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (566)..(566): a, c, t, g, unknown or other
  misc_feature (566)..(566): n is a, c, g, or t
tcagtagtgtagatcacgaccggtgctcgatttagctacgactgcaggggcagcaagatggtgttgcagacccaggtcttcatttctctgttgctctggatctctggtgcctacgggacacgtgatcgacccngtcnccagcctcctggctgtgtctgtggcgagcgggcctcatacaanganaacgtccngccagtacttgtttanacnncctacaacaaataagaactattacgnttgtatacagacaaacgaaaccaggacactaccctaactaaactgtactactaactttaacgngggacctaacgtccgtaaccggggtcgtcccgggtacccnggtacccagttcgaagtgacgcggtcggtaccgtggaccaggtcttcactctacacatacaactgctgacgngtcngaggtatggtacgagttatttaataactgtacgantagtaatataacgcttacgtcgtaacgtcgaacgaacggtgaagcgtaaananaacgtatggtacgagttcaactagtactcggttactcttaactcggtaacccttcccgactntccctaaag

SEQ ID NO: 169450 - DNA, 879 bp, Homo sapiens
  misc_feature: GYAE6OF01DGP69.37.11.A11.1.454.CMB.1.raw
tcagtagtgtagatcacgaccggtgctcgatttagctacgactgcaggggcagcaagatggtggttgcagacccaggtcttcatttctctgttgctctggattctctggtcgccgtacggggacaccgtgatcgacccagtctccagacctccctggctgtgtctcgtggcgaggacggcctcatcaactgacaagtccacgccagtacgttagttttaacaccagtcctaacaaactaaagtaactaaccttaacttagtacgttaggtatacgaacgacgaaacggaaaccgacggaccaacgtaccctaaccgtaaaaccgtcgtaccttacctaacgtttacggtacgggtaccttacggttacccggttaaccccgggggtacggttccccggggttaccctaacggtacccggttagtttaccgaagggttccggaaccggttacggggacgggttaccgtagggtaactaacgggtttaccgtttacctaaccgttccctaacccgaaccgtactaccgaaccgtaccgtcccgtacgtaccgacgggtcgtaacgggaggtacgttcgggtacggttacttttaacgtttaccgttactccgttacgtacgtaacgttaacgttaatttaaccgttaaccttacccggttccccgttaacggtaacccggttaccgggaaaccccgggtaagggggtaaccccgttaaagggggtaacttaaacccgttaacggtaaaaacccggtcggtttaccgggaccgttaccgtaaccgtaacccgtaaacctttacggttcccgttaaccggtttactttacccgtaaccctttaccccggtttcccaaaacccttcggttttaccgaaaacccg

SEQ ID NO: 169451 - DNA, 785 bp, Homo sapiens
  misc_feature: GYAE6OF01D97S8.37.11.A11.1.454.CMB.1.raw
  modified_base (213)..(213): a, c, t, g, unknown or other
  misc_feature (213)..(213): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagagggccctccatcaactgcaagtccagccagtacttgttttanacagctaccaaacaataagaacttactagtctttaggtatcgagacaagaaaaccgagggacacgacccttacctaaaactcgacttctaacgttttaacgtcgggtacctacgttacccggtaccccgggggtacggttccccggggtaccctcggaaccgtagttaccgaggttacggcgtacgggtccgggtacgtacgggaactacggtactttccacgttcctaccgtacctaactaccgaaacgtaccgtccgttacggaccgtaagggtccgtaagggaaccgggtagttacgggttacgggtactttaacgtttttaacgttaccggttacgttaccgtaaggtaccttaaggtttaacttttaacgtaaacctttaccgttacccgtaccgggttacccggttaccgggtacccggtaaacgggtaaccgtaaacgggttaacggtaaacgtaaaccgaaaacggtaccgttagggtaccggtcgttaccgaccgttaccctacgttccgtaacgttcccttaccgtacgtttccccgttacccgaccttacgttccgtaacg

SEQ ID NO: 169452 - DNA, 764 bp, Homo sapiens
  misc_feature: GYAE6OF01C67PK.37.11.A11.1.454.CMB.1.raw
  modified_base (136)..(136): a, c, t, g, unknown or other
  misc_feature (136)..(136): n is a, c, g, or t
  modified_base (692)..(692): a, c, t, g, unknown or other
  misc_feature (692)..(692): n is a, c, g, or t
  modified_base (738)..(738): a, c, t, g, unknown or other
  misc_feature (738)..(738): n is a, c, g, or t
tcagtagtgtagatcacgaccggtgctcgatttagctacgactgcagggcagcaagatggtgttgcagacccaggtcttcatttctctgttgctctggatctctggtcgccgtacgggacaccgtgactcgacccngtcctccacgtcctccgtggctgtcgtcgtcggtgggacgacggcggcctccataccgacgtcgacctaacgtccaacgccgtagtactttagtttaacaccgacgtaccctaacaaaacgtaaacgttaaacgtaacctttacttacggtcgtttaaggtactacgaacgaccgtaaaccgaaccggtacggacctaaccgtacccttaaaccgtaacgtccgtaccttactttaacggtttaccggacgggaccttaaccggttacccggggtaacccggggttaccgggtttccccggggtaccttacgggaaccgttcgtaccggtggtaccggtacggtcggtacgggttcggaacggtactacgttccttacgcctacgtacctaccagtaaccacgtcggctcggacgtacgcgaaggtgtacgtggtactaacttttagttgtaacgtgtaacgtcgtaaagtattaactacgttacctcccggtacccggtcggtaacggaccgacgggaaaacggtcgtaaaaggtctaaacaccggtaaacggtnttcgggacctccggactaaccgtatacgttcgtaccttccgttacnccccgttactcccgatacgtcgtaac

SEQ ID NO: 169453 - DNA, 647 bp, Homo sapiens
  misc_feature: GYAE6OF01DHKR2.37.11.A11.1.454.CMB.1.raw
  modified_base (352)..(352): a, c, t, g, unknown or other
  misc_feature (352)..(352): n is a, c, g, or t
  modified_base (639)..(639): a, c, t, g, unknown or other
  misc_feature (639)..(639): n is a, c, g, or t
  modified_base (642)..(642): a, c, t, g, unknown or other
  misc_feature (642)..(642): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtcctccagacctccgtggctgtcgtctcgtgggcgaggacgggcctaccactacaacgtcgacaacgtccacggaccagtacttagtttactacacgtacctaaccaaactaaataaacgtaacttacgttagtcgttaggtactacgaacgacgaacgaaaccggacggaccacgtacctaccgtaacgtcgtacttacgttactttaccggnggacctaccggtcccgggtaaccggggtccggtccccgggtccgtacgtaccgttacgtacgaggtcggacggcgggtcggtacgtcggactagttctacactacaccatactacaactcgcgtcgcgaggtacgacggagtacgtcgtagtacgttaattcgtactgactagtactaagttaactattactcgtaccgtacgtaccggtacgacgaacggtaacgaaggtaacgtaacgaacgtaacgtacgtagtgcacgtcattctctctctactctacctccnctntgtac

SEQ ID NO: 169454 - DNA, 849 bp, Homo sapiens
  misc_feature: GYAE6OF01EE7PE.37.11.A11.1.454.CMB.1.raw
  modified_base (369)..(369): a, c, t, g, unknown or other
  misc_feature (369)..(369): n is a, c, g, or t
tcagtagtgtagatcacgaccggtgctcgatttagctacgactgcaggggcagcaagatggtgttgcagacccaggtcttcatttctctgttgctctggatctcgtggtcgcgtacgggacacgtgatcgacccagtctccagacctcccgtggctgtcgtctcgtgggacgagacgggtcctccatcaacgtcgacagtccacgccagtactttagttttacaccgacgtacctaaccaaactaaataaacgtaacttacgttagttcgttaggtactcgacgacgaaacggaaaccgacgggacctaaccggtacccctttaaccgtaaaacgttccgtacctttaccttaacggtttttaacccgngggtacctaacccggttacccggggtaaaccccggggtccggggttacccggggtcccgtacgaaccggtttagttaccggaggttccggacggtacgggtccgggttaccggacgggtacgtagttaccttaccacgtttccaactaacctcgtacctaaacgccgtaccgttacgacgtacggtacgtaggtaggtacgttagggtacggttagtttaccttttagttaccgttaacgtacgtaacgtacgtttaagtttaacttaacgtaacccttttaccccgttaccgtttaccggtaacccgttacggtaacccggtaacgggtaaccgttaagggtaaccgtaaacgttaaccggtaaacggtacggttaacgggtacgtacgttacccgaaccgttacctacggttcccttaccggtttccttaaccgtttcccttacccccgttacggtacccttaaaggtcccttaaacg

SEQ ID NO: 169455 - DNA, 777 bp, Homo sapiens
  misc_feature: GYAE6OF01C9DBB.37.11.A11.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (476)..(476): a, c, t, g, unknown or other
  misc_feature (476)..(476): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatgacccagtctccagactccctggctgtgtctcgtgggcgagcggcctccatcaactgacaagtccagccagtacttgttttaanaccgancctaaccaaacaaataagtaacttacgttagcgtttaggtactacgaacgacaaacgaaaccggtagggaccacgtaccctaacctaaacgtcgtacttactattttacgcgggacctaacggtacccggtaacccggggacggttcccggggtccccttaggaccgttaactttcggaacggtcgggacgtacggtccgggtcggtaggtacctagttaacttcccgtaactccgttaccaacgtactaccgaaacncgtccgtacgacgagggtacctaggacgggttaagtgggtaacgtacctttaagttttacttaacgtggtaccaaggttacttaacgttatttaaagtaccgttaccccgttccgttaacccgggtaccggttaccgggaaccggtaaaaccggggtacgttaaaagggttaccgtaaaacgtaacccggtaaaaccggttacgtacgggttcgaccgttaacgaccctaacgtaagttccgttaccgtttacttacgtaacccgttttcccacccggtaaacctccgttaacgttaaacc

SEQ ID NO: 169456 - DNA, 706 bp, Homo sapiens
  misc_feature: GYAE6OF01CVGAT.37.11.A11.1.454.CMB.1.raw
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (320)..(320): a, c, t, g, unknown or other
  misc_feature (320)..(320): n is a, c, g, or t
  modified_base (443)..(443): a, c, t, g, unknown or other
  misc_feature (443)..(443): n is a, c, g, or t
tcagtagtgtagatcacgaccggtgctcgatttagctacgactgcagggggcagcaagatggtgttgcagacccaggtcttcatttctctgttgctctggatctctggtgccgtacggggacacgtgatcgacccagtctccagacctccctggctgtgtctcgtgggcgaggacggcctaccatccaatgacaagtccaagccagacttgtttanacganctaaccaacaaataaagaacttacttaggcttaggtatacaacgacaaacgaaaccgagggacacgtaccctacctaaacgtcacttactagtttacgngggactacgttacccggtaccgggtacggtcccggggttcctacggaccggtattcgagggtcggacgaacgggtcgggtaccgtagggaactaaggttaactttccaacttcaccaactaanacaaacgcgacctagacgaggcgtaggacggtagtggtcggactttatttactacgtagactagtacgtaattaattaagtaaccttacgtaccgtacccggtaacgttaccgggaaccgtaaaggggtaaccctaaagggtaacgtaaaacgacctaaaacggggactttcgggaacggtacaccgaacaacccgttaaccttcgttacgttcccttaactaacgttcccccgtttacccggaaccctagttccgtaaacgg

SEQ ID NO: 169457 - DNA, 653 bp, Homo sapiens
  misc_feature: GYAE6OF01ESE3C.37.11.A11.1.454.CMB.1.raw
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (397)..(397): a, c, t, g, unknown or other
  misc_feature (397)..(397): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaaacaataagaactacttagcttggtatcagcaacgaaaccagggcacgcctacctaaactgctctatttacngggtcatccgtaccgggagtcccgggcctgaccgnttcagtggcnggcggtctggacagtnttacactcctcgaccatcaaactacgcctcgcagggctacggaagntcggtaggtaccttaattttacgttacgtgtaccgtagtactaaggtttaaacttacgtaaatttaccccgtaccgtttacccggtaaccggtttaccgggaacccgaaacggggtaaccctaaaggggttaccggaaaataccggaaaacgtacgttacggacggtacccgtggaccccttaacgtacgttaccgttagtacccctttactaacccgtttcccttaacccccggtaacttctacccggttaaacg

SEQ ID NO: 169458 - DNA, 867 bp, Homo sapiens
  misc_feature: GYAE6OF01A4VBS.37.11.A11.1.454.CMB.1.raw
  modified_base (734)..(734): a, c, t, g, unknown or other
  misc_feature (734)..(734): n is a, c, g, or t
  modified_base (770)..(770): a, c, t, g, unknown or other
  misc_feature (770)..(770): n is a, c, g, or t
tcagtagtgtagatcacgaccggtgctcgatttagctacgactgcaggggcagcaagatggtgttgcagacccaggtcttcatttctctgttgctctggatcttctggtcgccgtacggggacaccgtgatcgacccagtcctccagtacctccgtggctgtgtctcgtgggcgagcggccctcgatcaactgacaacgtccagccaagtacttgtttaacacgacgtacctaaccaaaactaactaaacgtaactacgttagtaccgttaggaactcgaacgtaacaacggaaaaccggaggccaaccgtacctaacgtaactcgaccttactacgttacggtcggactacggtccggtaacccgggtcggtcccggtacctagtacccgtagttcgaggtcgacacgggtcggtacggtacggactacgttacttaccgactactaccgtaaccacgtaaacccgtaacgaccggtccgtaccggtacggtacgggtacttacggggacggtagttaccgggttacggttaaacctttaagttttaccgttacggtacgttaaccgtaacggttaactttaaacgttttaacgtttaaaccgaccttttaaccccccggggaccttttacccggggggaaaccgtttaaaccgggggaaaccccggtaaacccgggggttaaaacgtaccgggtttaaaagggtaaaacccctaacggtttaaaaccccggnggggtttacgtaaccgggtaccgtaaaccccggttnttaaaacccgttcgtttaccccgggttttaataacccccgtttcggttaaaccccttcccggtaaccccgttactaaacggttaccctaaaaccggg

SEQ ID NO: 169459 - DNA, 708 bp, Homo sapiens
  misc_feature: GYAE6OF01BOQDW.37.11.A11.1.454.CMB.1.raw
  modified_base (312)..(312): a, c, t, g, unknown or other
  misc_feature (312)..(312): n is a, c, g, or t
  modified_base (453)..(453): a, c, t, g, unknown or other
  misc_feature (453)..(453): n is a, c, g, or t
  modified_base (660)..(660): a, c, t, g, unknown or other
  misc_feature (660)..(660): n is a, c, g, or t
tcagtagtgtagatcacgaccggtgctcgatttagctacgactgcaggggcagcaagatggtgttgcagacccaggtcttcagtttctctgttgctctggatctctggtcgccgtacgggacaccgtgactcgacccagtctccagcctcccgtggtctgtgtctcgtgggcgagacgggcctccatcaactcgacgaacgtccacgccgaacgtacttgttttaacacagtcctaccaaaacaagttaacgacttaactgtcttaggtactcgagacaacgaaccgagggaccacgtcctacctaacgtcncctattactttacgcgggtactacgttccggtaacccggggtaacgggttccccggggtaccgttacggaccgttacgttacgtaggtcggtacgcgggccggttcgtacggacgtagtacctttcactcgaccaccttanacacgcacgtcgcggaggtccagggtacgtaggtcggtacgttcgttaatttacgttactcggtacagtaactaagtttacttaactaccttacccggtccttaccgggtaccgttaccggggaaacgtacccgggttaaacggaggttaaaacggtaactaaaccgggaaaccttacgggtatcggggtccttaacgccgtaaacncgttacgtcttccgtacccttactccccggtccgtataccgtgtaacc

SEQ ID NO: 169460 - DNA, 709 bp, Homo sapiens
  misc_feature: GYAE6OF01C13XF.37.11.A11.1.454.CMB.1.raw
  modified_base (174)..(174): a, c, t, g, unknown or other
  misc_feature (174)..(174): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
tcagtagtgtagatcacgaccggtgctcgatttagctacgactgcaggggcagcaagatggtgttgcagacccaggtcttcatttctctgttgctcgtggatctcgtggtcgccgtacgggaccacgtgatacgacccagtccaccaagcctccgtggctgtgtctcgtagggngaagtaccggccctacaactacaacgcgacgaacgtccgaacgcctaagtactttagttttaacacgtacacctaacaaaacgaaagttaacaaccgtttagtagtacgttaggtactacgacgaaacgaacgaaaaccgttgggacacgtaccctaacgtaaactcgcttacgttagtaaccgtggtactaccgttaccggaaccggtcgtccgggtacctacgactgttacgnggaccgngtagggccgtccggaagactaagttctaanccacgtacanactanaacccgtgcagacgngactaggaagtcgtggtagtacgtattaaggttctagacacgtaatagtaattacgtaactaccgtaccgtaaccggtacgtaaccggacggaacgggtaacgtaacggtaacgttaaaacgaaccgtaacgtaacgtaggtaaccggtagtaccgtaaccgtaacgtaccgttcgttaacggttctaacccgttaccgttacccgaaccccgttataaccgtcgttaaaccg

SEQ ID NO: 169461 - DNA, 861 bp, Homo sapiens
  misc_feature: GYAE6OF01B3NMS.37.11.A11.1.454.CMB.1.raw
tcagtagtgtagatcacgaccggtgctcgatttagctacgactgcaggggcagcaagatggtgttgcagacccaggtcttcatttctctgttgctctggatctcgtggtcgccgtacgggaccaccgtgactcgacccagtctaccagtacctcccgtggtctggttgtcctcggtgggacggaggaccgggtccctccataccgtaactcgaccgtaacgtccgacgtacctaacggttactttacgtttttaacacgacgtaccctaacctaaaacgtaaacgtaaaaccgttaacctttaacgttaggtaccgttttacggaactaccgtaacgaaccgaaaccggtaaaccgaccgggccgtaacccgttaacccttaacccgtaacgtccgtaccttacttaccgttaacggttcggggacccttaaccggtaccccgggtacccgggggttaccggttaccccggggtaccctacggtaccgtacgttcgacgggtcgacggtcggtcggtaccggtaggaactacgtcgttaccaccttacccgctaacctataccgaactacggtaccgtaggacccggaggtaccggtagggtaacggtcggttaggttacggttactttaacgtttaccttacggttcgtaacgtacgttaagttattaacgttaacttaaccgtacccgttacccgtaccgggtccgttaaccgggaccggtaaacggttaacggaacggtaacgtaacgtaccggtaaaccgttaggtcggttaccgtacgtacgtaccgtacttacgtcgttacggtttacctaccgttaccccgttaccttacccgacgttacctttcgtaaacccg

SEQ ID NO: 169462 - DNA, 738 bp, Homo sapiens
  misc_feature: GYAE6OF01A5R1R.37.11.A11.1.454.CMB.1.raw
  modified_base (213)..(213): a, c, t, g, unknown or other
  misc_feature (213)..(213): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctggggcgagacgggcctccatcaactgcaagtccagccagacttgtttttanacagtctaccaaacaataagaacttacttagcttggtatcgagacaacggaaaccgagggaccacgtaccctacctaaactcgacctctaattttaccgtgggactacgttcccggtaccccggggtaggttccccggggtaccctcggtaccgtacttcgacggtcggcgagggtccgggtcgtacggacgtagtactttcactctaccactactacaacgcgcctgaccgtaggctagggtacggtagttcggtacggtacgtttaacgttttagttacgtacgtccgtaaggtaccttaaggtttaactttaacgttaacttacccgttaccccgttaccggtaaccggtttacccgggaaccgaaacggggtaacccgaagggttaaacgtaaacgtaacccggtaaaacgtaacgttcgggacgtaccgtacggaccctaaccgttacgttccgttacgtttcccttaaccctttacgttccccccgttttacccggaactttacccgtaccgttaaacg

SEQ ID NO: 169463 - DNA, 806 bp, Homo sapiens
  misc_feature: GYAE6OF01CONPS.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtcctaccgagacctcccgtggtcctggtcgtcctcgtcgggacgaggacgggccctaccatacaacgtgacgaacgtccacgaccgtaacgtacgtttacgttttaacaacctacgacctaacccaaaataaaacgtaaagtaacctttaacgtacgtacgttaggttactacaacggacaaacgaaaccgagggacctacgtacccttaaccgtaaactcgacttactaacgtttacggccgggtactaccgtacccggtaccccggggtacggtccccgggtaccctacggaccgtattaccggaggtcgaccggaggtccgggttagacggtaacctagttaccctttaacaccgttaccaccaccgttaaacgtccgaaaccgcggtccgttgaccggtaggtacgtacgtaggttaacgtcggttagggacgtttaaatttacgtaacccgttggaaccaggtactaacggtttaacttaaactaaccgtttaccgtacccgtaccgggttaaccttaaccgggaaccgttaacgggaaaccggttaaggttaaaccggaaccgttaacgaaaacgtcggttggaccgtaccgttacgaccgtacttactaccggttcttaactacccgttacgttacccgtacccacctggttacctaacgg

SEQ ID NO: 169464 - DNA, 808 bp, Homo sapiens
  misc_feature: GYAE6OF01AW7V6.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccctggctgtgtctcgtgggcgagacggcctcatcaactgacaacgtccagaccagtacttagttttaacacgacgtcctaaccaaacaaataaacgtaacttacgttagtacgttaggtaactcgaagaccgaaacggaaaccggacgggacctaaccgtaccccttaaccctaaacgtcgtaccttacttaacgtttacggcgggtactaccgttacccgggtaaccccggggtacgggttccccggggtaccctacgggtaccgtacgtcgacgggtcggaccgtacgggtccgggttccggtacgggaacgtacggttacttaccgaccgttacccactaaccgactaaccgaacgtccgtaccgtcggaccggtacgggtacgtagggtaacggtcgttacgggttacggtaactttaagttttacgtaacgtcggtacgtaacgtagttaacgtttaaataccgttaaccgtccgtacccggttaaccggtaccggtaacccgggtaacggaaaccgggtaacccgtaaagggttaaccggttaaacctaacggaaaccgttggtccgggaacgtaccgaccgtacctaacccgttacttcgttccttaacgttccctaactttaccccggaaccctccgtaattcgtaaaccc

SEQ ID NO: 169465 - DNA, 751 bp, Homo sapiens
  misc_feature: GYAE6OF01BS72T.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagaccctaggtcttcatttctctgttgctctaggatctctggtgcctacggggacaccgtgatgaccaagtctccagactcctggctgtgtctctgggcgagaggcctccatcaactgcagtccagccagactgttttanacgagcctacgaacataagaactactagcttaggatcagcagaacgaggcagcctactaaactgctactactttacgtgggactagtccgtaacccggggacggttcccggggtacccttcggaacccggtctttaccgaacggttggaccgtaagggtccggggttcgtcggggtacctaagggtacttttaccaaacgtttccaccgaacccgtagttacccaaaaccgtacggtccccttagggtcccgaaaggggtccgttagggaaacgggttagttcgggttacgggtaccttaagttttacgtacgtcgttacgagtacctaagttaagttaacgtaacttacccgtaccgtaccggtacggtttaccgggaaccgtaacggggtaaccctaagggtaacggtaaacttaccgtaaaaccggtacgttacggtaacggtccgttaacgcccgtaaacccgttacgttccgttcggttacctttaccggtaacctttccccggttaccccggaactttaaccgttcggtttaaacccg

SEQ ID NO: 169466 - DNA, 757 bp, Homo sapiens
  misc_feature: GYAE6OF01EK4PM.37.11.A11.1.454.CMB.1.raw
  modified_base (519)..(519): a, c, t, g, unknown or other
  misc_feature (519)..(519): n is a, c, g, or t
  modified_base (552)..(552): a, c, t, g, unknown or other
  misc_feature (552)..(552): n is a, c, g, or t
  modified_base (569)..(569): a, c, t, g, unknown or other
  misc_feature (569)..(569): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtcctccacgacctcccgtggctgtgtctcgtgggcgaggacggcctccataccaacgtgacaacgtccacgccgagtacgtttagtttttaacactacgacctaccaaaaacgtaaactaaacgtaaccttacgttagtcgtttaacggtactacgacggaccaaaccggtaaaccggacgggacctaaccggtacccttaacctaaccgtcgtacctacgttaacgtttaccggcggtacctacgttacccggggtaacccggggtccggttcccgggtaccgtacggtaccgttagtccgaaggtcggaccggcgggtccggtacggaggtaactacgtcttaccaccgtcctaccaaccgtacaaccgactagtcccngtacgacggtcggtaagacggtcgtacgggttntaaacctttgtttacgngtcgtactagttaactagttttacaacgttaccctaccggttcccgtaacgggtaccgtaccggaaacggacgggttaacgtaaacgggtagtaaactaccgggaaacttggtacggcgtaccctacgtaccttactcgttacttacttcccgttaccacttcccccggtatacctgttaacggtacc

SEQ ID NO: 169467 - DNA, 786 bp, Homo sapiens
  misc_feature: GYAE6OF01C2XRB.37.11.A11.1.454.CMB.1.raw
tcagtagtgtagatcacgaccggtgctcgatttagctacgactgcaggggcagcaagatggtgttgcagacccaggtcttctatttctctgttgctcgtggatctctggtcgccgtacggggaccaccgtgatcgacccagtcctaccagacctcccgtggctgtcgtcgtcgtcgggacgaggacggcctaccatacaacgtcgacaacgtcacgaccagtacttagtttaactacacgtacctaaccaaactaaataaacgtaacttacgttaacgtcgttagtactacgacgaccaaacggaaccggacggacctacgtacccttaacctaaacgtcgtacttactaacgtttacggtacgggtacctaaccggtacccgggtacccggggtaccgggttcccccggggtccgtacggtaccgttacgttcgggacggtccggacggtacgggtcgggtacggtacggtaactacgttaccgttacctaccgtccacctaacctaacaccgtaaccacggtcgtacgacggtacggtacgtaggtagggtacgttacggtacggtaacttttaagttacttcggtcgtacgtagtacgttaaagttaacttaacgtacttacccgtaccgtacggttaccggtaccggaaaccggtaacgggtaaccggtaagtaaacgaaacgtacgtaaaacgtcggttacgccgtcgtacgtaccgtaacgttcttccgttacttacccttcctccccgttaccttaccccgattaccgttctaaacccg

SEQ ID NO: 169468 - DNA, 854 bp, Homo sapiens
  misc_feature: GYAE6OF01CKQUH.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctcacgactcccgtggctgtcgtctcgtgggcgaggcggcctacatacaacgtgacgaacgtccacggcctagtactttagttttaacaccgacgtacctaaccaaataaaagtaaacgtaaccttaacgtttacgcgtttaggtaactacgaacgaccgaaacgaaaccggagggtaccaacgtccctaacctaaagtctacttacttagttacggcggtaccaccgttcccggaaccggggtccggtcccggtaccgtacgaccgtagttccggagtcggaccggtacgggtcgggtacggtcggtaaactcggttaacttccacctttacgacccaaacctacttaaccgaaaccggtccgttccggagacccggtacgggtactaacggggtaaggtttcgtaggggttaccggttaacgtttttaaccttaaacggtttccggtaacggtacttaacgggttaaacctttaagtttaaacgttaaacccttaacccgtttaccccgtaccgtttaaacccggggttaccgggttaacccgggaaacccggttaaaacccgggggtaaacgttaacgggaaaccgggttaaaaccgtaccggtaaaaccggttagttccgggacccgggttacacccgtaaccgtacgttaccggttctttaccggaccctttaaccgtccctaccggtttacccacctagttccgtaaacc

SEQ ID NO: 169469 - DNA, 722 bp, Homo sapiens
  misc_feature: GYAE6OF01AZMS8.37.11.A11.1.454.CMB.1.raw
  modified_base (211)..(211): a, c, t, g, unknown or other
  misc_feature (211)..(211): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagaggcctcatcaactgcaagtccagccagtacttgttttaanaccagcctaccaaacaaataacgtaactacttagctttaggtatcagacaagaaaccgnggcacgccttaacctaactgctactatttaccgngggactacgtacccggtacccggggtacggttcccgggtccctacggaccgtacgtacgtagggtcggaccgtacgggtccgggttcgtacgggactaagttactttaccactcctaccacctaactacaacgcgtaccgtcgacgaggtacgtagggaggtagttgggttacgggtactttaatttacgttacgtacgtccaaggttaccttaagtttaattaactttaaccgttacccttacccggttacccggtaccgggtaaccggaacccggtaaacgggtaacgtaaacgggttaaagtaaacccgtaaccgaaacggtacgtacggtacgggtacctaccggtacctaaccgttccgtcgttcccgtaccttacccgtaccttcccgtaccccctactaccgtccgtaacg

SEQ ID NO: 169470 - DNA, 767 bp, Homo sapiens
  misc_feature: GYAE6OF01EDDIJ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacgggacaccgtgatcgacccagtctccacgactccctggctgtcgtctcgtgggcgagacgggcctcatcaactgcacgtccacgaccagtacttagtttacacacgacctaccaaactaaataaactaacgttacttagtacttaggtactacacgacaacgaaaccgagggactacgacctactaaactcgtctactactttacgtcggactacgtaccggtaccgggtacggtcccggtaccacggacctatacgaggcgtacggagggtcggtacgtacggactacgttacttcctactacgtacctaaccaactaacctaacggtaccgtacccgtaggtaccggtacggtacggtacggtaaggttacgttcgggtacgggttacccgtttaagtttaaccgttacgttacgtaacgtacggtaactttaacgtttaactttaactttaacctaccgttacccgttaaccggtaacccgggttttacgggaaaccccggaaacggggttaacgtaaacggggttaacgtaaagtaacccgtaaacgtaacgttcggaccgtacgttacccgaaccttaccttacggtttaacttcggtttaccctacctttaccgttacccgtaccctccgtttagtaccgttaacg

SEQ ID NO: 169471 - DNA, 674 bp, Homo sapiens
  misc_feature: GYAE6OF01DOQ0K.37.11.A11.1.454.CMB.1.raw
tcagtagtgtagatcacgaccggtgctcgatttagctacgactgcaggggcagcaagatggtgttgcagacccaggtcttcatttctctgttgctctggatctcgtggtcgccgtacggggacaccgtgtatcgacccagtcctccacgacctcccgtggctgtgtcgtcgtgggcgaggacggcctccatacaactcgacacgtcacgcctacgtactttatttacacacgtacctaaccaacgtaaataacgtaactacgttagtcgttagtactacagaacgaaacggaaccgacggaccaccgtccctaaccttaaacgtcgtacttactacgtttacgcggacctacgtaccggtacccggggtacgtcccgggtaccctggacctagtcggtacggcggtacgtagggtaccggtcgtagggtactacgttacttcctacgttccaccactaacgtacaacgtcgtcgacggcgagacgtagtacgggtatgttcgttacgttaatttacgacttcgagtagtacttaattattaactacttaccctccgtacggtacgttaccggaacgtaacgggaccggtaagaacgtaaccgaataaccgtcggttcgacggtagccgtactacctatccgtatccttactccttacccgacaccctgctaacc

SEQ ID NO: 169472 - DNA, 696 bp, Homo sapiens
  misc_feature: GYAE6OF01C6CTP.37.11.A11.1.454.CMB.1.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (318)..(318): a, c, t, g, unknown or other
  misc_feature (318)..(318): n is a, c, g, or t
  modified_base (447)..(447): a, c, t, g, unknown or other
  misc_feature (447)..(447): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagactccctggctgtgtctcgtgggcaggacggcctaccatcaactgcaagtccagccagtacttgtttanacngacctacaactaataagaacttacgttagtcttaggtacacaacgacgaacgaaacgagggacacgtaccctaaccgtaaacgtgacctactagtttaccgngggcctaaggtcccggtaaccggggcgtacccggggtccctaggaccgtaatttcgagtcggacgacgggtcgggtacgttcggactacggttcttaccgtactctaaccacctaacgtacaaacccgngttaccaggtacgtacggctagggaagttaacgtggttacggagtttaacttttaacgtacgtttacgtacgtacggtaccttaaattacgtttaactaaactttaccgtaccgttaccggtaacgttaccgggaaccgtaagggtaccgtaaaggtagtaaacctagaaaccgtacgtcgtaccggctagtacccgattacgtcctacgttctacctacgtttacccgtccctaacgtgtcccgtaag

SEQ ID NO: 169473 - DNA, 805 bp, Homo sapiens
  misc_feature: GYAE6OF01EW1BX.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggtctgtgtctcgtgggcgaggagggccctaccatacaacgtgaccaacgtccagccagtactttgttttaacacacgacctaaccaaaataaataaacgtaaccttaacgttacggtacgtttaggtactacgaacgaccgaaacggaaacccggaggggacctaaccgtacccttaacccttaaacgtggtacccttacgttaacgttttaaccggtcggggtacctaccgttaccccgggtaacccccgggggtaccgggttcccccgggggttacccctacggtaaccgttacgttaccggacggtcgggaccgtacgggtccggggtacgtacgggaacctagttacctttccaaccgttccaacctacctaacgtaccgaactaccgccgtaggaccgagggtctagggtacgtaggtacggtcgtacgtttaattacgttagtcgtagtaacgtctaagtttatttacttccgtttaccctctacgtaacgttacgggttacccgggacgggtaacgggtacctaacggtcggtaacggtacgtaccgtaccggtaaccgtaacgtacgggttcggtacgacgtaccgtacccgtaccgtacgtttccgtaccgtttaccttacccgtaaccgttccccgtaacccg

SEQ ID NO: 169474 - DNA, 807 bp, Homo sapiens
  misc_feature: GYAE6OF01CVZ1V.37.11.A11.1.454.CMB.1.raw
  modified_base (752)..(752): a, c, t, g, unknown or other
  misc_feature (752)..(752): n is a, c, g, or t
tcagtagtgtagatcacgaccggtgctcgatttagctacgactgcaggggcagcaagatggtgttgcagacccaggtcttcatttctctgttgctctggatcctctggtcgccgtacgggaccaccgtgactcgacccagtcctccagtacctcccgtggcttgtgtcgtcgtcgggcgagacggcctacatactaactgacaacgtcacgccagtactttgtttaacacagctaaccaataaataactaacttattagcttaggactacaagaccaaaggtaaccgaggacctaccgtaccttaaccttaacgtcgtacttacgttaacgttttacggtacggggaccttaaccggttaccccgggtaaccccgggggttaccgggttacccccgggggttaccccgtaaacgggtaccccgtttaaagtttcccgggtaacgggttccggggaaccggtaaccggggttccgggtaccgggtaacgggtaacctacggtttaaccttacccgtaacccttaccgtacccaaaccgtattaacccaaacgtccggtcctacgacggcgtacgtacggacggtagttcgggttacggttacgtttagtttaactaacgttccgtaacacggttaacttaagtttaactttaactaaccgttacccgtttacccgtaccggttaaccggtaccggaaccggtaacggtacggtaaacgggtaactaaacggactaaacgtacggtagccgtancggtactactacttctcgttacctcgttaccttaccgtacctctacgtacgtacg

SEQ ID NO: 169475 - DNA, 839 bp, Homo sapiens
  misc_feature: GYAE6OF01D4CUJ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacgggacacgtgatcgacccagtcctccgacgacctcccgtggtcttgtgttcgtcgtgggcggacggcgggccctccgatacaacgtgacaacgtccacgaccgtatacgtttagttttatacgtacgtacctaaccaaactaacgtaaactaacttaacttagtcgttaggtactacgacgtaacgaaacgaaccggacggactaccgtaccctaacctaaactcgtaccttaccgttacgtttacggtacggtaccgtaccggttacccgggtacccgggggtacccgggtaccccggggttccgtaccggtaccggtacgttacgtaacggtcggtaccggcgggtccggttacggtacgggtacgttacgttaactttaccggtacctttaccgtaacccgtaaccctaacgacccgtaaccgacggttccgtacggtaccggacggtacggtaggaaccggttagttaggttacgttaacgttagttttaccggtaaggttcgtagttaagtacgttaaagttttattaaccgtaaccctttacggttacccgtaccgggttaccgtaccgggaacgggtaacgggtaacggaacggttaagaaaccggttaccgtaaacgttccggtacgttaccggtactacccggaccgttaccctacgttccgttcctttacctaccttaccctcccgttaacccgttacttcgggtaacttaccg

SEQ ID NO: 169476 - DNA, 817 bp, Homo sapiens
  misc_feature: GYAE6OF01B4XBZ.37.11.A11.1.454.CMB.1.raw
  modified_base (135)..(135): a, c, t, g, unknown or other
  misc_feature (135)..(135): n is a, c, g, or t
  modified_base (214)..(214): a, c, t, g, unknown or other
  misc_feature (214)..(214): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccngtctccagacctcctggctgtgtctcgtgggcgagacgggcctcatacaatgacaagtccagccagtacttgttttaanacagcctaccaaactaaataaacgaacttacttaagcttaggtactacgagacaacgaaaccgagggcacgtaccctacctaaacgtgaccttactaagtttaccgcgggtacctacgttacccggacccgggtacggtccccgggtaccttcggaaccgtattcgacggtcggaccagggtccgggttacgtcgggaacctaggttactttaccacgtttccacctaacctacgttaacccgacgtacgcccgttacgtaccggaacggtcgttagggaacggttacgtacgggtttacggtacgttttaaacttttaacgttaccggtttagtaacccgtaggttaaccgtaaggttttaaacttaaacgttaaccgtttacccgttaaccccggttacccgggttaaccgggtttaacccgggaacccggttaaacggggaacccggttaaaggttaaccggaaaactaacggtaaaaacccgtacgttacggggtaaccgtaccggtaccgtaaccgtaccccgttaggtaccctttggtttaccccttaaccgtcccctttaccgttaccccggaccttaacgttaccgttaaacccg

SEQ ID NO: 169477 - DNA, 944 bp, Homo sapiens
  misc_feature: GYAE6OF01AKIY0.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacaccgtgatgacccagtctccagacctcctggctgtgtctcgtgggcgaggacgggccctccatacaactgaccaacgtccacgcctaagtactttgttttaacaccgacgtcctaccaaactaaataacgtaaccttacgttacgtacgtttaggtactacgaacgaccaaacggaaaccgaggggtccaaccggtaccccttaaccgtaaacgttcgacctttacgttaacgtttttaccgggcgggtaccttaaccggttaccccgggttaaccccggggggttaccggggttacccccgggggttcccctacgggtaaccccggttacgttttaccggaacgggtttcggggaccgtaacgggggtccggggttaccgggtacgggtaacgtaacggtttacttttaccccgacctttacctacccgtaaccctaacgtaacccaaaccgtaccggtcccgtaacggacccgtaaggggtccgtaagggtacggtaggttcgggtacggttaacgttttaacttttaacgttacgtacggtaccgtaacgttaacgtaagttttaaacttaaccgttaaacccgtttccccgttaacccccgggtttaccggttaaccggggtttaaccccgggaaacccggttaaaccggggggtaaccgttaaaacggggtaaacgttaaaccgtaaacccgaaaaccgggttcttacggggtaccgtaaccgtccggtaaacctacccggttacgttcccggtttaaccgttccttaaccggttccctttacccccgtacccggtaccttcgtaacccgttaaccg

SEQ ID NO: 169478 - DNA, 776 bp, Homo sapiens
  misc_feature: GYAE6OF01EDM8I.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgcctacgggacaccgtgatgacccagtctccagactccctggctgtgtctctgggcgagacggcctcatcaactgacaagtccagccagtacttgttttaactacacgtacctaccaaactaataaacgtaacttacttagtcgtttaggtatcaacgacaacggaaaccgacggccacgtaccctacctaaacgtcgtactacgttaacgtttaccgtcgggtacctaccgttacccggtaccccgggggtaccggttccccggggtacccgtaccggacccgttaacgtacgtacggtacggaccgtacgggtaccgggtcgtagggactacggttactttccgaccttccgtacccaactactacccaaacggtacctcccgtacgtaacggtacggtagtacggtaggtacgttcgggttacggtaccgtttaattttaccgttacgtacggttaaccgtaacgttactttaacgtttaactttaactaaccctttacccgtacccgttaccggtaaccgggttaacccggaacggtaaaccgggtaaccgtaagggtaacgtaaaccgtacgtaaaaccggtcgtaggtacgtctaccgtacctataacgttctacgttctaaccttacctaccccttacccgtacttaccgtgtaaacccg

SEQ ID NO: 169479 - DNA, 763 bp, Homo sapiens
  misc_feature: GYAE6OF01C2K7L.37.11.A11.1.454.CMB.1.raw
  modified_base (159)..(159): a, c, t, g, unknown or other
  misc_feature (159)..(159): n is a, c, g, or t
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatgacccagtctccagacctccgtggctgtntctcgtgggcgaggacggcctccatcaactgacaacgtccacgccagtacctttgtttaacactagcctaccaaacaaataacgtaacttacttacgcgtttaggtactcgaacgacgaaacggaaaccgngggaccacgtaccctaacctaactcgtaccttacgtacgtttacgngggacctacgtccggaccggggtcgtcccggggtcctacggacgtattcgaggtcgcgtacggcggtactggaactacgtacttcacgttcctacacgtaactacgaacgcgtcgtcgacggcggttagtacgggtagtacggttcggtaacgttacgtttaacgttttacgttccgtagttaacccgtaggtaacctttaagtaacttttaacctaaaccgttcccgtttccgggttaacccggttaacggtaaccgggtaaccggtaaacggggttaaccaaacggggttaaacctaaacggtaacctaaaccgggtactacgggttccgttaacgtacggtcccttaacggttcgttaccggtcctttaacccgtacccgttccgtttaccccgtaccccgtacttaacgttaacccttaacgg

SEQ ID NO: 169480 - DNA, 777 bp, Homo sapiens
  misc_feature: GYAE6OF01D92U5.37.11.A11.1.454.CMB.1.raw
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (209)..(209): a, c, t, g, unknown or other
  misc_feature (209)..(209): n is a, c, g, or t
  modified_base (592)..(592): a, c, t, g, unknown or other
  misc_feature (592)..(592): n is a, c, g, or t
tcagtagtgtagatcacgaccggtgctcgatttagctacgactgcaggggcagcaagatggtgttgcagacccaggtcttcatttctctgttgctctggatctctggtgcctacgggacaacgtgatgacccagtctccagactcctggtctgtgtctgtggngagnggcctccatcaactgcaagtccgagccagtacgttgttttanacgcgctaccaacaataacgaactacgttagtcgttaggtatacgagacgtaacgaaaccgacgggactaccgacccttaccgtaaaactcggtacttacgtaacgttttacgtacgggtacctacggttacccgggtaacccggggtacggttccccgggggtaccctacgggtaccgttaacgtttcgacggtacgggtacgtaacgggtccgggttacggttacgggaacctaaaggtaaccttttaccaaccgttcgtaccctaaccgaacgttaacccgaagtaaccgtccgtagacccgtaagggtaccttaagggacggtaagtacgggttacggtacttttaaacgtttacgttaacgttcgtaacgtaaacgtnttaaacgttaactttaataacttacccgttacccgtaccggtaaccggttaccggaaccggtaaacgggtaaacgtaaggggttaactaaacgtaacgtaaaccggtacgtaggtccggactacggtaccctaagtcttaacgcgttacgtaacctcgtacccgtaccgtctagttccgtaaacg

SEQ ID NO: 169481 - DNA, 738 bp, Homo sapiens
  misc_feature: GYAE6OF01CDH1D.37.11.A11.1.454.CMB.1.raw
  modified_base (233)..(233): a, c, t, g, unknown or other
  misc_feature (233)..(233): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcgtccagacctcccgtggtctgtgtctcgtgggcgaggacgggtcctccatccaacgtgactaacgtccgacgaccgaggtactttgtttttaanaaccacgtacctaaccaaaactaaagtaaacgtaacttacgttagtcgttaggtatacgagacaacggaaaccggacggacctacgacccttacctaaacgtcgtacttacgtagttaccggtggacctccggtaccggtaccggggtaccggtcccgggtaccgtacgaccgtacgttcggaggtcggacgtacgggtacgggtacggacggtaacgtagttacttcgtactaccacgtacctactaaccgacgacgtccgtacgtacgacggtggtacgggtaggtacgttacgggtacgttaacggttttacttttacgtaacccgtgggtacctaaggtaacttaagtttaactaacgtaactcccgtaccgtacggtccgttaacggaccgaagggtacgaaggtaacaacgaccgttaagtcgtcggtcgacgtacgcctaacttcgttccgtacgttcttaacgtccgtttaccgacccgttcttaaggtacctaacg

SEQ ID NO: 169482 - DNA, 755 bp, Homo sapiens
  misc_feature: GYAE6OF01CR4VA.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcaggggcagcaagatggtgttgcagacccaggtcttcatttctctgttgctctggattctctggtcgcgtacggggacacgtgatgacccagtctcagctccgtgctgtgtctgtgggcgaggacggcctcatacactgacaagtccagccagtacttagtttanacagtacctaccaaactaaataacgtaacttacgttacggcttaggtactacgaacgacgaaacgaaccggagggacctacgtaccctaacctaaacgtcgtctacgttacgttacgcggtaccacggtcccggtaccggggtacggtcccggtaccaggtacctagttacggaggttcggacgcgggtcggtacgtcggtaactacgttacgtttcaaccgttacctaacgccttaaatccgaaatccgggtacccaggacggtacggtacggtacgggtaggttacgtttaggtacgttaccgtttaagtttaccgtttactcggtactaacggtagttaaacgttactttaaacgtaccttacttaccggtacgttaaccgtaaccggaacgaaccgggtaacggttaaacggaacgttaaacggacgtaaaccgttacggacgggttacgacgttaaccggtaccttacttaacggttctttaccggttaacctttaccgtaccccgtttaaccgccccgttaactacggtttaacgtaacg

SEQ ID NO: 169483 - DNA, 845 bp, Homo sapiens
  misc_feature: GYAE6OF01CJ6AA.37.11.A11.1.454.CMB.1.raw
  modified_base (291)..(291): a, c, t, g, unknown or other
  misc_feature (291)..(291): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatcgacccagtcctccagacctcccgtggctgtgtctcgtgggcgaggacggcctcatacaactgacaacgtccacgaccagtacttgttttaacacagacctaccaaactaataaacgtaacttacgttagtcttaggtactcgacgacgaaacggaaaccggnggggaccaccggtaccccttaaccgtaaacgtccgtaccttacgtaacgtttaccggttacgggacctaccggttacccggtaccccggggtacggttccccggggtaccctacggtaccgtagttcgagggtcggacgtacgggtccgggtcgtacggggactaacgttcttccgacctcctaaccaccacgtaacaaacgtcggtccttggacggtacggcgttaaggaggttacgtacgggttacggttaacgttttaatttaacggttcgtaacggaccgtaaacggttacgtaaagttttaacgtttaaaccttaacccgttaccccggttaccgtaacccggggttaccgggtaacccgggtaaaaccggaaaccggggggttaactaaaggggttaaacctaaaccgttaaccggaaaacggttacggttccgggaccggttacgtaacccgtaccctaaaccggtttagttccccggttacgttttaacccttccctaccggtttttaccccccaccccggttaacttacgtttaacctaacccgg

SEQ ID NO: 169484 - DNA, 692 bp, Homo sapiens
  misc_feature: GYAE6OF01BJYCV.37.11.A11.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttaatacagcctaccaaacaataaagactacttagcttggtancgagacaagaaaccgagggacacgacctactaaactcgctactatttacngggacacgtaccgtacccgggacggttcccgggtcctacgaccgtattccgaggtcggcgacggtcgggtcgtacgggactacggtatttccgaacttcccgtaccaaccctaagtacccgtaaaaccgaccgtaccgttacgccgtaacgggtacccgttagggaacgggtagtcggggtttacggaccgtttaattttaacgttacgtgttactacggtactaagtttacttaactacttacctcctaccggtacgtaccgggactaaggggaaccctaagggacgtaacgttaccgaaacgttacggtaggtcggaccttacggacctaacctacggttccttacggtcctttactcccgttacttaccccggtactagtttccgtaaacg

SEQ ID NO: 169485 - DNA, 695 bp, Homo sapiens
  misc_feature: GYAE6OF01B8NH6.37.11.A11.1.454.CMB.1.raw
  modified_base (644)..(644): a, c, t, g, unknown or other
  misc_feature (644)..(644): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagtacttgtttatacagtctaccaaacaataagaacttacttagcttggtatcagacaacgaaaccagggcagccctacctaaactgcctctatttacgtgggctaacgtccgtacccgggacggtcccggggtccctcggaccgtattcgacggttcggctaggccgggttcgtagggaacctagtactttccaacgtctaccaacctaactaccaaacgtacggccctagtccgaagggtcctagggtaacggattcggttacgggtacgtttaaacttttaacgttaaccgtggttaccgaagtaccgtaaagtttaactttaaacgttaacttaccgttacccgtaccgttaacggttaccgaaccggtaaacgggtaccgtaaagggtacgaaacgttaccgaaacgtacgtggtaccgtctacggacctaacctacgtttccngtttacccttaccgtaactttcccctaccccggaacctagttccgtaaacg

SEQ ID NO: 169486 - DNA, 720 bp, Homo sapiens
  misc_feature: GYAE6OF01B0UJW.37.11.A11.1.454.CMB.1.raw
tcagtagtgtagatcacgaccggtgctcgatttagctacgactgcaggggcagcaagatggtgttgcagacccaggtcttcatttttctgttgctctggatctctggtgcctacggggacaccgtgatgacccagtctccagactccctggctgtgtctctgggcgagagggcctccatcaactgcaagtccagccagactgtttatacagctaccaaacaataagaactacttagcttaggtatcagcaagaaaccgagggcagcctacctaaactgctctatttacgtgggactactccgtacccggggtacggtcccggggtccctcgacccgtattcgaggtcgggacgacggtccgggtcgtaggggactagtactttcgactcctaccgacctactacaacgacgccgtcgacagggtcctagggacggtagttcgggtagggtaccgttaattttaacttacgttgtacgtagtacgtaagttaatttaactaacttacccgttacccgttacccggttaacggttacccgggaacccgtaaacggggtaaccgtaaaggggttaacggtaaaacgttaaccgtaaaacggtaacgttacgggtacggtaccgttacggaaccctaacccgtacgtttaccgttacgttacccgtttaccttaaccgtttccccgtttaccccccgacttaacttcccggtaacgttaaaccg

SEQ ID NO: 169487 - DNA, 801 bp, Homo sapiens
  misc_feature: GYAE6OF01DK0G2.37.11.A11.1.454.CMB.1.raw
  modified_base (131)..(131): a, c, t, g, unknown or other
  misc_feature (131)..(131): n is a, c, g, or t
  modified_base (170)..(170): a, c, t, g, unknown or other
  misc_feature (170)..(170): n is a, c, g, or t
tcagtagtgtagatcacgaccggtgctcgatttagctacgactgcaggggcagcaagatggtgttgcagacccaggtcttctatttctctgttgctctggatctcgtggtcgccgtacgggactccgtgancgacccagtcctcgatacctcctggcgtgtcgtctcggngggacgaggacggtccctacaatccaaacgtcgacgtaacgtccacggtaccgtaagttacgttttagtttaacaacgactacctaaacaaaactaaaacgtaacgtaaaccttttaccgttaggttccgttaaggttacaacctaacggaaccaaacggaaaccgtacgggaccgtaccctaacccgtaacctaacgtcttaccttacttaacgttaccggtagggacctacggtaccccgggtaccgggtccggttccccgggtaccgtacggaccgttagcggtaaggtccggacggtaccgggtcggtacggtacggtacgtacgttacttccaccgtccgtacacgtactaccgaacgacgtcgtaccgagtcgacgttaggagtacggtgtacgttacgttaattgtacgtcgtacgtagacttaagttacgttaaccgttacgtacccgttcgggtaacccgttccggtaacggaacccgggtaacgggaacttaagggtaaaccggtaactaacccgggaagttaccgtacggtcgaacccggttacacccgttaacggttacttccgttacgttacccttaccggtacccctttccgaacccgtccttaaggtccgtaaccg

SEQ ID NO: 169488 - DNA, 718 bp, Homo sapiens
  misc_feature: GYAE6OF01B9KUZ.37.11.A11.1.454.CMB.1.raw
  modified_base (474)..(474): a, c, t, g, unknown or other
  misc_feature (474)..(474): n is a, c, g, or t
  modified_base (663)..(663): a, c, t, g, unknown or other
  misc_feature (663)..(663): n is a, c, g, or t
  modified_base (706)..(706): a, c, t, g, unknown or other
  misc_feature (706)..(706): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatcgacccagtcctccagacctcccgtggctgtcgtcgtcgtgggcggacggacggtccctaccactaccaactcgacctaacgtccgacgcctaagtacgtttgttttaacaacctacgaccttaaccaaaaactaaacgtaaacgaaaccttacgttaacgtacgtttaggtaactacgaacgacgaaccggaaaccgagggacctaacgtacccttacctaaactcgaccttatacgtttacggtggacctacgtcccggtaacccgggtcggttcccgggtacctagaccgtacttcgaggtacggccgtacggcggtacgtacggtacgtacttaccgttacnccgttccacctaaccacgtaacaacccgaccggtcccgagacgtcgtaggacggtagtcgggtacggttaagttaacgtttactacgttacgtagacgtaacgttataaactttacgtaacctaccgtccgtaaccgtacggtaccgaacggtaacggaaccgtaaggtaacgtaactaacgaacgtancggtggaccctgactaccagttctacgtctcgtactcgtaccntctagcctaacg

SEQ ID NO: 169489 - DNA, 754 bp, Homo sapiens
  misc_feature: GYAE6OF01AE5ZQ.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtcgtctcgtgggcgaggacggcctccatcaactgacaacgtccagccagtacttgttttaacacacgtcctaaccaaactaaataaacgtaacttacgttagccttaggtatcagacaagaaaccgnggactacgcccttactaaacgtgccttacttacgtttacgcgggtacctacgttacccggtacccggggtaccggttccccgggggttaccctacggtaacccgtagtttacgacggttacggcgtacgggtcgggtacggtacggtaactacggttactttaccaccttaccgtaccctaacctacgtaacctaaacccgaccggtcccgttaggacggtaccggtacggtacggtaagggtacttgggtacggttaacgtttaattttacgtaacgtgtacgtaacggtacgtaatttaattaacgtaaccttccgttacccgttaccgtacggttaccggaccggtaacgggtacgtaaacggttagaaaccgtaacgaaacgtcggtacgtcgtaccgtacgaccgtaccttacgttccttcgtttacctaccgttccttccccgttacgcccttgttccgtaaacg

SEQ ID NO: 169490 - DNA, 705 bp, Homo sapiens
  misc_feature: GYAE6OF01CSXW8.37.11.A11.1.454.CMB.1.raw
tcagtagtgtagatcacgaccggtgctcgatttagctacgactgcatgggcagcaagatggtgttgcagacccaggtcttcatttctctgttgctctggatctctggtgcctacggggacaccgtgatgacccagtctccagactccctggctgtgtctcgtgggcgaggacggccctcatccaactgacgaacgtccagccagtacttgtttaacacacgcctaccaaactaaagtaacgtaacttacgttagtcttaggtatcagacaacgaaaccgacgggcaacgtaccctacctaaactcgtacctactagtttacggcggactacgtccggtaacccggggtcggtcccggggtcctacggtacgtacgttcgacggtggccgaggtcggtcgacggtacagttacgttcacttcgtaccactactaccaacgtcgtccgacgtacgacggtacgtagggaagtcgtaggggttacgtacgttaacgttttaacgtacgttacgaccgtaagtacgtaaagtttactttaacgttaacccgttaacccgttcccggttaacccggtaccgggttaacccggaaccgggtaacgggtaacggtaaacggtaacgtaactaacggtaacgtacgtggtcgacgtacgtacctacgtgttacctcgtttctaaccgtcttccccgtaaccgtctacgttacg

SEQ ID NO: 169491 - DNA, 749 bp, Homo sapiens
  misc_feature: GYAE6OF01EAN7T.37.11.A11.1.454.CMB.1.raw
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctcagactccctggctgtgtctcgtgggcgagacggcctcatcaactgcaagtccagccagtacttgttttanacacgctaccaactaataacgtaactacttagtcttaggtatcagacgaacgaaaccgtgggcacgtccttactaaactgacgtactagtttacgngggcctacgtccggtaacccggggtacggttcccggggtacctacggaccgttatttcgacggtcggaccgtacgggtcgggtaccgtagggaactacggttaacttcccgacttccgtacgtaccgtacgtaccgaaacgtcggtacccgtcggtaaccgagggtcccgtagggtaacggtagttacggtacgggtaaccgtttaagtttaaccgttacggtacggtcgaacgttacctaaggtttaaactttaggttaaaccttacccgttacccgttaccggtaaccggttaccgggaccggtaacggggtactaaacgggtcgtaaacttaccggaaacgttacgttcggtacgtaccgttacggacccgtaaccgtaggttcctaccggttccttaccgttcccttacccgtaccccggactttacgtccgttaaaccgg

SEQ ID NO: 169492 - DNA, 751 bp, Homo sapiens
  misc_feature: GYAE6OF01BWFZN.37.11.A11.1.454.CMB.1.raw
tcagtagtgtagatcacgaccggtgctcgatttagctacgactgcaggggcagcaagatggtgttgcagacccaggtcttcactttctctgttgctctggatctctggtcgcctacggggacaccgtgatcgacccagtcctccagacctcccgtggctgtgtctcgtgggcgaggacggccctcatacaacgtgactaactccacgccgacgtacttgttttaacaccacgtcctaaccaaataaactaaacgtacctaacgttagtcgttggtatacgaacgtaccgaaggaaaacccgcgggacctaacgtaccctaccgtaaactcggtacctaccgttaagtttccggtcggtaccacggttaccggtaccccggggtacgggttccccgggtacctacgtacccgtagttccgtacggtacggccgtacggggtccgggtagtacgggaacctaggttaccctttacgcctttaccgtaccaaccgacgtctaaaccgtcgcccgtacggacgtcggtcgtaggtacggtaaggtccgtagggtaacgtttaccttttaaggtccgtaggtactacgtaacttaagtttactaacgttaaccttcccgtaccgtaccggtacgttacccgggaaccggtaacggtaaccgtagggttaacgtaataaccgaacgttagtcggacgtactaggaccctagtaccttgttacctcctacgtcttaccccacctactagttacctacg

SEQ ID NO: 169493 - DNA, 742 bp, Homo sapiens
  misc_feature: GYAE6OF01BXIRV.37.11.A11.1.454.CMB.1.raw
  modified_base (263)..(263): a, c, t, g, unknown or other
  misc_feature (263)..(263): n is a, c, g, or t
  modified_base (426)..(426): a, c, t, g, unknown or other
  misc_feature (426)..(426): n is a, c, g, or t
  modified_base (693)..(693): a, c, t, g, unknown or other
  misc_feature (693)..(693): n is a, c, g, or t
tcagtagtgtagatcacgaccggtgctcgatttagctacgactgcaggggcagcaagatggtgttgcagacccaggtcttcatttctcttgtttctctggatctctggtgccgtacggggacaccgtgatcgacccagtctccagacctcccgtggctgtgtctcgtgggcgagacgggcctccatcaactgcaagtccacgccagtactttgtttaatacagcctaccaactaaataagtaacctacttagtcgttggttanacgacgcaacgaaacgaggcctacgtaccctacctaatcgcttacgtaatttcgacgggtactacgtaccggtacccggggtacggtccccgggtacctacggaccgtcgttacggagtcgcgtaggtcggtcgaggaactagtactttacaccgtctaaccnctaacctacaacgtcgtccgtacgacgtacgcgtaggaaggtgttggtacgtaaccggtttaactttaaggtcgttacagtacgttattaacgtttaactaacgttaacctttaccctaccggtttaaccggttccggttaaccgggaaacccggtaaccgggtaaacccggttaaaggttaaggtaaaacctaacgggtaaaccggtaacgttcgggtaaaccggcggttaccgacccggtactttaccttacggttacccgtttntaaccccgtactttcccggaccccttagtaaccttgtacctttaaaccg

SEQ ID NO: 169494 - DNA, 793 bp, Homo sapiens
  misc_feature: GYAE6OF01EIK2Z.37.11.A11.1.454.CMB.1.raw
  modified_base (165)..(165): a, c, t, g, unknown or other
  misc_feature (165)..(165): n is a, c, g, or t
  modified_base (172)..(172): a, c, t, g, unknown or other
  misc_feature (172)..(172): n is a, c, g, or t
  modified_base (702)..(702): a, c, t, g, unknown or other
  misc_feature (702)..(702): n is a, c, g, or t
  modified_base (774)..(774): a, c, t, g, unknown or other
  misc_feature (774)..(774): n is a, c, g, or t
tcagtagtgtagatcacgaccggtgctcgatttagctacgactgcaggggcagcaagatggtgttgcagacccaggtcttcatttctcgtgttgctctggatctcgtggtcgccgtacggggacaccgtgatacgacccagtcctccagactccgtgctgtgtcncggtggngacggcggcctccagtacaacgtcgacgaaacgtccgaggtaccaagttacgtttacgtttttaacgacgaacgacctaaccaaaataaagtaaacgtaaacttacgtagtacgtttggtaactcgtaacggaccgtaaaacgaaaccggaacgggtccgtaaccgtaccttaaaccttaaacgtcgtaccgttaaccttaagttttacggaggaccgtaccgttaccgggtaaccccggggtcggggtccccgggtaccgacggtaaccgtctagtacgggtcggtacgcggtcgggtcgtacggagtcgtaactcgactcacgactagcctagtacgcgacgtcgggcgtacgtacggtaacgtacggtggttacgggttaacgttttaacgtacggtagttaaccgggactaacggtttacgttaacgtttacgtttaacccgtttctaccgttaacgttaaccggtttacgggtttaaccggaacgggttaaccggtaaccggtaggtaacgggtgggttaaaccncggttaacggacccgtacgggtacgtaccggtccgtactaccggtctaccgtacttcgttactacgttaacncccgtttcccgtcgtaccg

SEQ ID NO: 169495 - DNA, 683 bp, Homo sapiens
  misc_feature: GYAE6OF01BU5KX.37.11.A11.1.454.CMB.1.raw
  modified_base (386)..(386): a, c, t, g, unknown or other
  misc_feature (386)..(386): n is a, c, g, or t
  modified_base (675)..(675): a, c, t, g, unknown or other
  misc_feature (675)..(675): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagtacttgtttatacacgctaccaaacaataacgaactacttagtcgttagtactcaagacaacgaaaccagggcaacgcctacctaaactcgtactactaactttacgacgggctacgtacccgtacccggggtacggttccccggggtcctcgaccgtagttcaggtggacgacggcggttcgacgganacgttagttccacttcctacaaccactaccgaacacgcctacgccgaacgggtctggaagggttagtcggttacggtaccgtttaaattttacgttaacgtcgtaccgtaagtacgtaaagtttaaattaacttaaacgtttacctaccgtaccggttaccggttaccggtaccgaaacggggtaacccgtaaggttaaacggtaaactaacggtaaaaccgtaggttcgtacggtaccgtagtaacccgattacttcgtacgttcttcgtaaccttcccgttacactntacgtacg

SEQ ID NO: 169496 - DNA, 728 bp, Homo sapiens
  misc_feature: GYAE6OF01AWT1O.37.11.A11.1.454.CMB.1.raw
  modified_base (213)..(213): a, c, t, g, unknown or other
  misc_feature (213)..(213): n is a, c, g, or t
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctcgtgggcgagacgggcctccatcaactgacaagtccagccagtacttgttttaanacagctaccaaacaataacgtactaacttagcttggtatcagcaagaaaccgngggcacgcctacctaaactgctctatttacgngggcatccgaccgggtacggtcccggggtccctgaccgtattcagttcggcgacggtcgggtcgagggacctaaggttactttccaaccgttctaccgaacctacttaccgaaaaccgccggcctacgaccgtagggtcctagggacggagttggtcgggtaacttaagttttacttacgtagtacgaaggttacaagtttaattaactaaacttacccttacccgttacccgggtaacggttttacccgggaaccggtaaaacggggtacccgtaaagggttaacgggtaaactaaaccgtaaaacggtacggttacggtccggtaccgtaacgtcccgtaaacccgtaacgttcccgtttacggtttacctttccgtaaacccgtttttcccgttaaccccgtaccgttaccctttacggttaaaccg

SEQ ID NO: 169497 - DNA, 895 bp, Homo sapiens
  misc_feature: GYAE6OF01B9WMK.37.11.A11.1.454.CMB.1.raw
  modified_base (225)..(225): a, c, t, g, unknown or other
  misc_feature (225)..(225): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatcgacccagtcctccagacctccctggctgtgtctcgtgggcgaggacgggccctccatacaactgacaacgtccacgccaacgtacttgtttttaanacgacgtcctacaaacaaagtaacgaaccttacgtacgtcttaggtaactcgaagacaaacggaaaccgagggtacctacgtaccccttaaccgtaaaacgtcgtaccgttaacttaacgtttacggacggggtacctaaccggtttaccccgggtaacccccggggggttaccgggtttcccccggggggttacccgtaccggtaacccggttaacgtttacgggacggtggggaacccgtacggggtaccgggttaccgggtaacgggtaaccgacggttttaaaccttcccgtactttacccctaacctaacccgaacttacccgaaaacgtccgtaccggtacgaacccggtggtaacgtcgggaacggttagttacgggttaaggtacgtttaagttttacgtaacgtgggtaacttacgtagttaaacttaacgtttaactaaccttacccggtaacccgttcccggggttaacccgttaaccgggaaaccgaaacccggggttaacggaaacgggttaacggtaaaacttaaaccggaacgggtttaaacggtcggtccgttaaacgcccgtaaccgtaccgttaacgtttcccttacgtttacccgttaactttaccccggttaccccgttaaccccacccgttagttaacccggtaaaccg

SEQ ID NO: 169498 - DNA, 772 bp, Homo sapiens
  misc_feature: GYAE6OF01D4EQX.37.11.A11.1.454.CMB.1.raw
  modified_base (217)..(217): a, c, t, g, unknown or other
  misc_feature (217)..(217): n is a, c, g, or t
  modified_base (455)..(455): a, c, t, g, unknown or other
  misc_feature (455)..(455): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatgacccagtctccagactccctggctgtgtctcgtgggcgagagggccctccatcaactgacaacgtccagccagtactttgttttanacacgcctaaccaaacaaataaacgtaacttacttagtctttggtaactcaagacaaacggaaaaccgacgggccaacgtacccttacctaaatcgtcttactagtttacggcggtactacgtacccggtaacccggggtaccgggtccccgggtcccgtacgaccgttagtcgaggtcggcggtacggcgggttcgacgggactagttaccttcacttccactaccaataccaaacncgcgtagcggagtcgtagaaggtgttaggtcggtaactttaattttacgtacgttacgtaccgaagttacgttaagtttaacgttaactaaacggtttacccttacccggttaaccgtacccgggttaacccggaacggtaaaaccgggtaacggttaaagggtaaaccggtaaaacgtaaccgtaaaaccggttaacggttcgggtaccgtccggtaacgtaacccacccgtttaattcccggtttaccctttacccgttacccttaaccccgtttccccgttaacccccggaccttaaaccgttccgttaaaccg

SEQ ID NO: 169499 - DNA, 757 bp, Homo sapiens
  misc_feature: GYAE6OF01DLGBD.37.11.A11.1.454.CMB.1.raw
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
  modified_base (750)..(750): a, c, t, g, unknown or other
  misc_feature (750)..(750): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgactcgaccctagtcctccgagaccttccctgtcgtcgctacttcttagtaagagtacgagacgtccaacctgtccgtcgttcgggaccgggtcgtacggtacgaacggtaacctacgtacccgttatttaagttttacggacgtccgttggtaactacgacgaacgtaggaaccggtacggacggtaacctaaccgttccacttaacttcttagtacttacgtagtggtatcgtacttaaccgtttccgtaggttacggttacggaaccggtccggtacggttctacgtacgttccggttacggtcgtaggtcggacgtacggtcggtagtaccggtcccggtcccttacgttaaccnccgttacctaaccnccttaaccgacccgtacgtacccgcccgttacgacgtaaccgtaaggaactttgtaccgttacttaacttaactttacgtaccgtaactacgtaaacgttagtacgtaccggtagttacccggtaccgggttcggtacggtacccggaccggtaccggtaaacgggtaaccgaacggttaagaccgtaacggaacgtcggtacgtcggactacgacctcagtttacctgtactcttactccgtcccgtcngttaccg

SEQ ID NO: 169500 - DNA, 817 bp, Homo sapiens
  misc_feature: GYAE6OF01DND57.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtctccagacctccctggctgtgtctcgtgggcgagacgggcctaccatacaactgacaacgtccagccagtactttagtttactacacgtcctaccaaactaaataacgtaacttacgttacgacgtttaggtactactacgaccgaaacgaaaccgagggaccacgtaccctacctaaacgtccgtactaccttacgtttacgcgggtacctaacgttcccggtacccggggtaccggtaccccggggttcccgtagtaacccggttacttaccgggaacggtcggaccggtacgggtcggggttacgtacgggtaacctacggttactttaccaccgtacctacctaacctaactaaccgtaaccgaccgtaccgtaccgacgggaacggtccgtaagggtaggtcgtacggggttacgttaacgttttaatttaacgttacgtcgttactaagtaccgttaattttaacttaaacggttaccctacccggttttacccgaccgggtttaaccgttaaccgggaaacccggtaacggggtaaccgtaaaggggttaacgaaaaccgtttacgaaaaggttaccggtggttacgcctaacgggtacctaaccgttatttccggttccttaaccttccgttaacccttcccgtcccggtaacctaggtttcctaaaccg

SEQ ID NO: 169501 - DNA, 753 bp, Homo sapiens
  misc_feature: GYAE6OF01BK3JM.37.11.A11.1.454.CMB.1.raw
  modified_base (605)..(605): a, c, t, g, unknown or other
  misc_feature (605)..(605): n is a, c, g, or t
tcagtagtgtagatcacgaccggtgctcgatttagctacgactgcaggggcagcaagatggtgttgcagacccaggtcttcatttctctggttgctctggattctcgtggtcgaccgtacggggacacgtgatcgacccagtcctccagcctcctggctgtgtctcgtgggcgaaggcggccctcatacaactcgacctaacgtcccgacgaccgtaagttacgttttagttttaacacgaacgtaccttaaaccaaaacgtaaataaaacggtaacctttacgttacggtacgtttagtaactaccgagaaccgaaacggaaaccggcgggaccacgtacccttaaccgtaactcgtaccttcttaacgttcggacggtaccttacccggtaccggttaccccggggccggttccccgggttaccacggtaccgttacgtcggtacggcggagtaccgggtcggtcggaacggtacttaacgttcttaccgaccgtctaacccgacgtaacttacccgaaacgtcgccggtacgacggaccgtcgtagggaggtttcgcggttcggttaacgtttaatttcgttacgtacgttacaaacggttnttaacgtttaaataccgttacccgtaccgttccggtaacgtcggtaaccggaacgtaacgggactaaggtaacgttaacgaacgtagccgttgaccgtctacgcctagttcctgtcttcctcttaccgtcccttccattccgctaacg

SEQ ID NO: 169502 - DNA, 811 bp, Homo sapiens
  misc_feature: GYAE6OF01C0TQP.37.11.A11.1.454.CMB.1.raw
  modified_base (322)..(322): a, c, t, g, unknown or other
  misc_feature (322)..(322): n is a, c, g, or t
  modified_base (452)..(452): a, c, t, g, unknown or other
  misc_feature (452)..(452): n is a, c, g, or t
  modified_base (515)..(515): a, c, t, g, unknown or other
  misc_feature (515)..(515): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgactcgacccagtctccagtacctcccgtggctgtgtctcgtgggcgaggacgggcctaccataccaacgtcgacgaaacgtcccgacgaccaacgtactttagttttaacaccgtaacgtcctaaaccaaaactaaaataaacgaaactttacgttagacgtttacggtactacacgacgaaacggaaaaccgngggacctacgtacctaacctaactcgtaccttacttacgttagtcgggactacgtacccggaccggggtacggtacccgggtacctagggacctagttacgaggtcggacggtacggcgggtttaccggnggtaacctagttacgtttacccacgtacctacgaactaactacgaaacgtcgtacgcggaacncggaaccgtaggaacggtgttacggacggttaactttaatttaacggttaacgtcggtacgaagtacttaagtttaacttaaacttaacgttccccgtaccggttaccgggtaaaccggttacgggtaacccgaaacccggggttaacgtaaacggggttaactaaaacgtaccggtaaaacgttacgggtaccgttacgggacccacgggttacccaaccggttactttcggttacgttcccttaaccccgtacttttacccccggtacctacctaacgtttaccgtaaaaccgg

SEQ ID NO: 169503 - DNA, 635 bp, Homo sapiens
  misc_feature: GYAE6OF01A5WJ2.37.11.A11.1.454.CMB.1.raw
  modified_base (216)..(216): a, c, t, g, unknown or other
  misc_feature (216)..(216): n is a, c, g, or t
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (395)..(395): a, c, t, g, unknown or other
  misc_feature (395)..(395): n is a, c, g, or t
  modified_base (451)..(451): a, c, t, g, unknown or other
  misc_feature (451)..(451): n is a, c, g, or t
tcagtagtgtagatcacgaccggtgctcgatttagctacgactgcaggggcagcaagatggtgttgcagacccaggtcttcatttctctgttgctctggatctcgttggtgccgtacggggacaccgtgatcgacccagtctccagactccctggctgtgtctcgtgggcgagacgggcctcatcaactgcaagtccacgccagtacttgttttanacacgtctacaaacaataacgaacttactagcttgtatcagtcaacgaaaccngggccacggcctaaccgtaaactgtaccttactacgtttacgngggactacgtccgtaacccggggnggtcccgggtcctacgaccgtatccgaggtacggcgacggtcggtcgagggactacgtnttccgacgttcaccacctagtacaacgcgtccagccgtagcgtagacgtagtcggngtacgttatttacgtacgtattcgaacgtcctaagttaacttaattaccgtactcccgtacggtaccgtacgacggaacgggttaaccgaaggtacgaaactaccgaacgtacgtgtaccgacgtcgaccgactcttacggttccttcttcgtaaacttccccggtatcccgtagttctaaacg

SEQ ID NO: 169504 - DNA, 869 bp, Homo sapiens
  misc_feature: GYAE6OF01E39K8.37.11.A11.1.454.CMB.1.raw
  modified_base (812)..(812): a, c, t, g, unknown or other
  misc_feature (812)..(812): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctaccacgacctcccgtggctgtcgtcctcgtgggcgaggacggccctaccatacaacgtgaccaacgtccagtccgagtacttagtttaacaccgacgtacctaccaaaactaaagtaacgtaaaccttacgttacgtacgtttaggtactaccgacgacaaccggaaaccggacgggacctaaccggtccctaacccgttaaacgtcgacccttaacgtaacgttttaccggacggggtaccttaacggtaccccggttacccgggggtaccggttaccccggggttacccgtaacggacccgtttaacggttccgaagggttccgggaccgtacgggtcccggggttccgtaacggggtaacttaacggttacctttaacccgaccgttaaccccttaccctaacccgaactttaacccggaaaaccgtcccgtaccgggttacgtaaccggtaacgggtcggttaacggaggttacgggtacggttcgttaacgttacgtttttacacgtttcgacgtaacgttactaagttaaacgtttacctaacgttccgtacccgtaccgtaccgggttaacccggaaccggtaaccgggtaacgtaaacggtaaacgtaaccgtaacgtaacggtacgttacggtccgtacccgtacgaccgtaccgtaccgtnttaccgttaccgttaccttcccgtaccccgttaacccgcttaaccgtcgttaaaccg

SEQ ID NO: 169505 - DNA, 910 bp, Homo sapiens
  misc_feature: GYAE6OF01AFY1H.37.11.A11.1.454.CMB.1.raw
tcagtagtgtagatcacgaccggtgctcgatttagctacgactgcaggggcagcaagatggtgttgcagacccaggtcttcatttctctgttgctctggatctcgtggtcgccgtacggggacaccgtgatcgacccagtcctaccgagacctcccgtggctgtcgtctgtgggcgaggacggccctaccatacaacgtcgactaacgtccgtacgaccagttacttcttttaacacacgacctaccaaaactaaataacgtaaaccttacgttacggtcgtttagtaactacgacgaaccgaaacggaaacccgacgggactaaccgtacccttaacctaaacgttcgaccttacgttacggtttaccgtagggaccgttaccgtaccccgggtaccccggggtaccgggttccccggggtccctacgaccgtatcggaggtcggacgtacgggtccggtcggtacggtaacgtacgttaccttcctacgttacccctacctaccgtaacctaacccgaacgtaccggacccgtaggcccggtaagggtcgtagggttacgggtacgggtttacggtcggttaaccgtttaagttttaacggttccgttaaccggtaccgttaaggtaaacccgtttaaagttttaaacgtttaacctttaacccgtttacccccgtaacccggttacccccgggtttaaaccgggttaaccccggggtaaacccggtaaaaccggggtaaccggttaaaacgggttaacggtaaaacccctaacgggtaaaccccgttaagggtacccggttaaccgggtacctaacggttaccccgtagttacctttcccggtttaacctttaacccttacccgtttaccccttccccgtaacccccggttcctacgtttacgtaac

SEQ ID NO: 169506 - DNA, 806 bp, Homo sapiens
  misc_feature: GYAE6OF01CI3CM.37.11.A11.1.454.CMB.1.raw
  modified_base (734)..(734): a, c, t, g, unknown or other
  misc_feature (734)..(734): n is a, c, g, or t
tcagtagtgtagatcacgaccggtgctcgatttagctacgactgcaggggcagcaagatggtgttgcagacccaggtcttcatttctctgttgctctggatctcgtggtacgccgtacggggacctaccggtgactcggaaccctgtcctaccagacctcccgtggtctagttcgtcgtcggtgggacgaggaccggcccttacattaccaacgtcgactaaacggtccaacgcctacgtacgtttagttttaacaccgacgtacctaaccaaagtaaataaaccgtaacctttacgttacgtcgttaggtaactacgaaggtaccaaacgggaaaccgtacggacctaccgtaacccttaaccgttaaacgtccgtaccttacgttacgtttaccgggcgggtactaaccggttccccgggtaaccgggggttcccggtccccgggttaccctacggaccgttacttcggagggttccggaacggaccgggttcggtaacggacggtaacttacgttaccgtttccaaccgtacttaaccaaccttagaaccccgagtaccgtccgtaggaccgttaggacgttagggacgtcgttacggggtacttacggtttaatttacgtacgtataccggattaacgttagttaacttaacctaccgttaccgtacccgtacggtaccggtaccgaacccggtaaggtaccgttaagtaacgaacgtacgtaaacggtnttacggactaccgacgtacctacgtacttcgttactacccgttctaccgacccttcgacttcgtacgtaacg

SEQ ID NO: 169507 - DNA, 752 bp, Homo sapiens
  misc_feature: GYAE6OF01B40VR.37.11.A11.1.454.CMB.1.raw
  modified_base (100)..(100): a, c, t, g, unknown or other
  misc_feature (100)..(100): n is a, c, g, or t
  modified_base (129)..(129): a, c, t, g, unknown or other
  misc_feature (129)..(129): n is a, c, g, or t
  modified_base (137)..(137): a, c, t, g, unknown or other
  misc_feature (137)..(137): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
  modified_base (626)..(626): a, c, t, g, unknown or other
  misc_feature (626)..(626): n is a, c, g, or t
tcagtagtgtagatcacgaccggtgctcgatttagctacgactgcaggggcagcaagatggtgttgcagacccaggtcttcatttctctgttgctctggntctcgtggtcgccgtacgggacaccgtgntcgacctntcctaccagcctccgtggtctggtcgtcgtcggtgggacgacgggaccggtccctaccacgtacccgaaccgtacgaaccgtaccacgaccgtagttacgttttacgttttaacacggtacctaccttaaaccgaaactaaaagtaaacttaaccttacgtttaacggtcgtttaaggtacaccgaagaccgaaacgtaaccggacggaccaccgtaccttaaccgtaactgtcctttacgtacgtttacggcggacctaccggtaaccggtcccgggtacggtcccgtcacggtctagtggacgcgtacggcggtcggtggacgtactacgtactcctacgcctcaactgaacctagccgtccngacgtcgagttcgngtagtgtacgtattacgttacgtagtactagtagtacgttaattaacttaacgtacccttaccgtaccgtaccggtttaacgccgggtaaacggtaccggaacgggtaanaccgggtaactaaacggttacccgagtttacggcaacccggttacaaccgtcgtttacccggttttacccgtttaacccctacccggtttacccctaccgtataaccgtttcgtaactttaccccg

SEQ ID NO: 169508 - DNA, 827 bp, Homo sapiens
  misc_feature: GYAE6OF01EAYD1.37.11.A11.1.454.CMB.1.raw
  modified_base (388)..(388): a, c, t, g, unknown or other
  misc_feature (388)..(388): n is a, c, g, or t
  modified_base (811)..(811): a, c, t, g, unknown or other
  misc_feature (811)..(811): n is a, c, g, or t
  modified_base (817)..(817): a, c, t, g, unknown or other
  misc_feature (817)..(817): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgactcgacccagtctccgagacctccgtggctgtgtactcgtgggcgaaggtacggccctaccatacaacgtcggacaaacgtccgacgaccgaagtaccgtttagttttaacgaccgacgtaccctaacccaaaacgtaaaattaaaaccggtaaacctttacgttaaggtaccgtttaggtaactacaaggaccaaacggaaaacccgcgggtacctaccgtaccctaacctaaacgtcgaccttacgtactttaaccggnggtacctaccggttacccggtaacccgggggtcccggttaccggggttacccgtccggtaacccgttagttccggtaagggtcggaacggtacggtcgggtacggtacggtacgtaagtaaccttttcaccgtcctaaccgaaccgtaacgacgaaaacccgtcggtaccctcggtaacgtacgggtaccgtagggttaacgtaagggtccggtttaaggtaccgtttaaagttaccgtttaagccggtaacgttaacgtacttaaaggtttaacttaaaccttacgttaaccccgtcccggttacggtaaccggttcccggaaacggtaacgggtaaacggtaaggtacgaaacaccggttaaacggacgtacgttcggctaccggaacctgttacgtcctagttacctcgtacttaccccnccgtanacgtcgtaac

SEQ ID NO: 169509 - DNA, 825 bp, Homo sapiens
  misc_feature: GYAE6OF01CBWO4.37.11.A11.1.454.CMB.1.raw
tcagtagtgtagatcacgaccggtgctcgatttagctacgactgcagggggcagcaagatggtgttgcagacccaggtcttcatttctctgttgctctggatctctggtgccgtacggggacaccgtgatgacccagtcctcacgactcctggctgtgtctcgtgggcaggtacggcctcctataccaacgtcgacaacgtccgaacggccagtaccgttattttaacgaccggactacctaccaaactaagtaaacgaccttagtacgtacgttacggtacttacgaagaacgtaacgtaaacgacgggtacacgttacctaccgtaaactgtactacgtacgtttcgacggtcaacgttcccggtaaccgggtacgggtcccgggttaccgtacggtaccgttacgtacggtacggtcggtaccgttaacggggcgggtttaccggacgggaactacggtaaccgtttccaccggtttaacctaccggaccgtaaccgttaaccgaaacccgtacgtaacgtcggaccgttaggacccggttagggtaacggtagttaccggttaggtaacgtttacgtttaaaccggttcttacggtacgaacgttaccggttaaagtttaactttaacgtaacccgtttaacccgttacccgggtaacggttaaccgggttaaccgacggggttaaacccgggacgtaacgggtaacgtaactaacggtaaacgcggtacggttcgaaccgttacgtaccgtaccggtacttaccggttcttaccgttaccggtcccttacccggtacccttcccagttaccccggtaacg

SEQ ID NO: 169510 - DNA, 856 bp, Homo sapiens
  misc_feature: GYAE6OF01A8BVJ.37.11.A11.1.454.CMB.1.raw
  modified_base (275)..(275): a, c, t, g, unknown or other
  misc_feature (275)..(275): n is a, c, g, or t
tcagtagtgtagatcacgaccggtgctcgatttagctacgactgcaggggcagcaagatggtgttgcagacccaggtcttcatttctctgttgctctggatctctggtcgcctacggggacaccgtgatgacccagtctccagacctccctggctgtgtctcgtgggcgagcgggcctccatcaactgcaagtccagccagtacttgttttacacagcctaccaaacaataacgaacttacttagctttaggtactcgacgacaacggaaaccgngggccacgtccctacctaactgaccttactagtttacgcgggacctacgtcccggtacccggggtacggttcccggggtccctaggtacccgtagttcgtaggttcggacgtacgggtccgggtacggtacgggacctaggttacctttaccgaccttccctacctaacccgtactacccgaaacccgtccggtacccgtacggaccgtaggggtaccgttaggggaaacgggtcgtttaggggtacgtttaccggtttaaagttttttacgtaacccgtttcggtaaccgtaagttaacccggtttaacgtttaattttaaccgtaaacccgttacccccgttttaccccgggttaacggttaaccccggggtttaaccggggaaccccggtaaacggggggttaaccctaaaaggggggtaacgttaaaaccctaaccgggtaaaaacccgttcgggttacggttaccgggaccttttaccgggaacccgttaacccttacggttcgtttacccggtacccttttacccgtacccgtttacccccggttaccccgacgtttaagtacccgtttaaacgg

SEQ ID NO: 169511 - DNA, 968 bp, Homo sapiens
  misc_feature: GYAE6OF01EN2O4.37.11.A11.1.454.CMB.1.raw
tcagtagtgtagatcacgaccggtgctcgatttagctacgactgcaggggcagcaagatggtgttgcagacccaggtcttcatttctctgttgctctggatctcttggtgccgtacgggacaccgtgatcgacccagtctccacgactccctggctgtgtctcgtgggcggaagacgggccctaccatacaaactcgaccaacggtaccacgaccagacttgttttaataaccgacgtacctaaccaaaactaaaataaacggtaaaccttacgttaacgtcgtttacgggtaactaccaagacaaaacggaaaaccgagggcctaacgaccttaccgtaaaactcgtactactaacgtttaacgtacggtacctacgttaccggtaaccccggggtacggttcccccgggggtaccctacggtaaccccgttagtacccgtagggtacggtaccggtaacgggtccggggtaccgtacggggtaactaacggttaacgtttacccgtacttacccgttacccgaaacctaaccttaaccgaaaaaccgttcgtacccgttacgtacggtaacggccggttaaaggtaacgggtagttcgggttaacgggttacggttaaattttaaccgtttaaccggtacggtactaacggtaacgttaaacggtttaactttaaagttaacccgtttaacccggtttaccccgttaacccggttaacccccgggggttaaccgggtaaaccccgggttaaaaaccgggggtaaaccccggtaaaaggggtttaaacccgggtaaaacctaaccggggtaaaaacgtaaaccggtttggggtaacccgtaacgggttaaccggaaaccccttaacgttaaccgttacccggttttaaccggtttaacccgtttaaccccgttaaccgttacccccgtttaaaccccgtaccgttaacccggttaacttaaaccggg

SEQ ID NO: 169512 - DNA, 822 bp, Homo sapiens
  misc_feature: GYAE6OF01BLZ2Q.37.11.A11.1.454.CMB.1.raw
  modified_base (81)..(81): a, c, t, g, unknown or other
  misc_feature (81)..(81): n is a, c, g, or t
tcagtagtgtagatcacgaccggtgctcgatttagctacgactgcaggggcagcaagatggtgttgcagacccaggtcttnatttctctgttgctctggatctctggtcgccgtacggggacaccgtgatcgacccagtcctccagacctccgtggtctgtcgtctcgtgggcggaggacgggccctaccagtccaacgtcgactaacgtccacgaccgtagtacctttagttttaacaacgacgtaccctaacctaaaactaaacgttaaaacgtaacttaacgttacgtcgtttacggtaactacgacgaaccgtaaacggaaacccggtagggaccgaaccgtaccctaacctaaacctcggtacctacttagtttaccgcggtactaccggtaccggtacccgggtccggggttcccggtacccgtacggaaccgtacgtacgtacgggcggtccgtacgggtccgggttacggacggtactagtacgtttaccacttcccgacctaactactaaccgaaacgccgtcgtacggagtacggtcgtagggagtacgtcggtaggttactttaacgtttgtacttagtacctaggtactaagttaattacgtaaaccgtttccgtaacccggttaccgggttaaccgggtaccgggtaaacgggaaaccgggtaaacggtaacggggttaacaaaccgttaacggaaaaccgttcgggttacgtccggtaccgtaaccgtccgtaaccgttaattccggttacgttcctttacccgttacccttaccccggtttacccactttaaccgacgtttaaaccg

SEQ ID NO: 169513 - DNA, 777 bp, Homo sapiens
  misc_feature: GYAE6OF01D7XYA.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctcccgtggctgtgtctcgtgggcgagacggcctccatcaactgacaagtccagccagtacttgttttaatacacgcctaccaaacaataaacgaacttacttagtcttaggtatcagacaacgaaaccggaggccacgtaccctacctaaactgtacctctaacgttttacgcggacctacgttacccgggtaccccgggggtacgggttccccggggtaccctacggtaccgtacgttcgacggttcggaccgacgggtcggggtcgtagggacctaggttactttccacttcctacctaccgtaattaccaaacgtcggtaccctaggccgtaagggtccgtagggaaggttcgttagggttacggggttaactttaacgttttttaagttacccgttaggtaaccgtagggtaaccgtttaaattttaatttaaaccgtaaccttttacccgttccccgttaaccggggttacccggttaccgggaacccgggtaaaccgggtaaccggtaaagggtacgtaaaccgtaccgaaacggtacgttgggtacgtaccgtacgacccgtaacttcgtacgttcgtaccctttacgtacccgtttcccctaccccgtcttacggtccttaagg

SEQ ID NO: 169514 - DNA, 745 bp, Homo sapiens
  misc_feature: GYAE6OF01AU5X8.37.11.A11.1.454.CMB.1.raw
  modified_base (320)..(320): a, c, t, g, unknown or other
  misc_feature (320)..(320): n is a, c, g, or t
  modified_base (684)..(684): a, c, t, g, unknown or other
  misc_feature (684)..(684): n is a, c, g, or t
tcagtagtgtagatcacgaccggtgctcgatttagctacgactgcaggggcagcaagatggtgttgcagacccaggtcttcatttctctgttgctctggatctctggtcgccgtacggggactaccgtgatcgaccagtcctccagacctcccgtggctgtcgtctcgtgggcaggcggcctcatcaatgacaacgccacgccagtacttagtttacacgactctaaccaaataagtaacgaacctttgtaacgtcgtttaggtacacctacgaacgaagaaaccgtacgggacctacgtacccgtaacctaaccgttcnccgttactactttaacggcgggtacctacgtaccgggttaacccggggtaccggtcccgggttaccctacggaccgttagtcggtacgtacggcgtacggtcgggttccgaggactacgttactccgactctaccacgtatacaacgcgctacgggactacggcggtaacgcggtaaggttgtcgggttaacttacgtttacgttacgtacggttccgtaacgtaacggtttaactacgtttaactaccgtaccccggttaccgtacccgggtaaccgttaaccggggtacccggaaaagggtaccgttaaacgggttaacggtaaaccgacggtaaaaccgtggttacgggctaacccgggtnaaccgtcttaacgtcgttactacccttctacccggttacctcccttgtaccgtccgtaaac

SEQ ID NO: 169515 - DNA, 905 bp, Homo sapiens
  misc_feature: GYAE6OF01BPD46.37.11.A11.1.454.CMB.1.raw
  modified_base (165)..(165): a, c, t, g, unknown or other
  misc_feature (165)..(165): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgaccagtctccagacctcctggctgtgtcgttcgngggacgaggcgggccctaccataccgaacgtcggacctaacgtccacggaccagtactttaggtttttaacaacacgtacctaaccaaaacgtaaaagttaaaccgaactttaacgttacgtctttaggtaactcgaacgaacgaaaacgaaaccggacggaccaacggtaccctaacctaaacgtcacgtttactacgtttacggcggacctacgttacccgggtacccggtacggtcccgggtaccgtacggtaaccgttagttaccggaagggttccggaccgtaggggtaccggttacggtacggtaacgtaacgtttacttacgaccttaaccgttaccaaccgtaacgttaacccaaacgtccggtaccctacgggaccgttacggggaccggtttaaggaagggttacggtttcgggttaacggttacccttttaaaaaggtttcccgtttaacgtggtaaccgtaggttaaccgttaaagttttaaccttaaaaccggtactttttaccccggtaaccccgggttacggtttaaccccggggtaaccgggaaacccgggaaacccgggttaagtaaaacggggtaacgttaaaaccttaacccgggaaaggttaaccggttcggtaaaccggtaccaaccgggtaccttaaccgttacgttccggtttaacccttccgttaaaacgttccccttaaccggtttacccccacggttattaacccgttaaacgg

SEQ ID NO: 169516 - DNA, 811 bp, Homo sapiens
  misc_feature: GYAE6OF01C7LC2.37.11.A11.1.454.CMB.1.raw
  modified_base (93)..(93): a, c, t, g, unknown or other
  misc_feature (93)..(93): n is a, c, g, or t
  modified_base (480)..(480): a, c, t, g, unknown or other
  misc_feature (480)..(480): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (558)..(558): a, c, t, g, unknown or other
  misc_feature (558)..(558): n is a, c, g, or t
  modified_base (758)..(758): a, c, t, g, unknown or other
  misc_feature (758)..(758): n is a, c, g, or t
tcagtagtgtagatcacgaccggtgctcgatttagctacgactgcaggggcagcaagatggtgttgcagacccaggtcttcatttctctgttnctctggatctcgtggtcgccgtacgggacaccgtgatcgacccagtcctccagacctcccgtggcttgtcgtcctcggtagggcgaaggcggtcctaccatacaactcggactaacgtccgacggaccctaagttaccttttagttttaacaaccctacggtaacccctaaaccgtaaaacgtaaaacttaaacggtaaacctttaccggttttagtacgtttaacggttactacggaaacgaccgtaaaaccggaaacccggagggacctaaccgttacccctaacgttaaacgtccgtacttacctaacgtttcggacggtacctaacggtcccggtacccggggtaccggtcccgggtcctacggaccgttactcggaggccgngaccgggtcggtacgtaggtaacctgggttaaccttccgacgtacctacaaccgtaacncggtaaacncgtaccgtanaccggtgtaacgtgacggtgtacgtaggttatttacgttagttacgacgtcgtaagtacgttaacgttaagtttaacctttaaccgttacccgtcccgttaaccggtaaccggtacgtaacccgggtaaacgggtacggtaaacgaacggttaaaacctacggtaaaaccgttcgtccgtagtccgtacgaacccgttancgtttacgttaccgttacttctaccgtttacccacccggtacaacgttatacc

SEQ ID NO: 169517 - DNA, 720 bp, Homo sapiens
  misc_feature: GYAE6OF01AFL1M.37.11.A11.1.454.CMB.1.raw
  modified_base (216)..(216): a, c, t, g, unknown or other
  misc_feature (216)..(216): n is a, c, g, or t
  modified_base (278)..(278): a, c, t, g, unknown or other
  misc_feature (278)..(278): n is a, c, g, or t
  modified_base (320)..(320): a, c, t, g, unknown or other
  misc_feature (320)..(320): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgaggacgggcctccatcaactgacaagtccagccagtacttgttttaanacagcctaccaaacaaataacgaacttacttagcgtttggtatacacgacaacggaaaccgngggaccacgacccttacctaaactcgacttactatttaccgnggcctacgtccgtacccgggtacggtcccgggtcctacgtaccgtagttcgaggtcggacgtacggtcgggtcgtacgggactacgttactttccacctctacccaaccgtactaccgaaccacgtcctggacgacggtcgtaggagggtagtcgggtacggtacttaactttaggttacgtacgtactagtataacgtttattaacgtaaccttccctaccggtacccgtacgttacccggggaaaccgtaacggggaaccgttaagggtaacgtaaactaaccggtaaacgggtaccgttgggtaccgtacgtccgtacctaaccgttacgttccgttacggttcccttaaccgttacccgtttaccccttaccccggacttaccgttcgttaaaccg

SEQ ID NO: 169518 - DNA, 822 bp, Homo sapiens
  misc_feature: GYAE6OF01EQJY9.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacgggacaccgtgatcgaccagtctccagacctcctgctgtgtctcgtgggcgagacggcctcatacaactgaccaacgtccagaccgtagtacctttagttttacaacacgtacctaaccaaactaaagtaaaccgtaaacttacgttacggtacgtttacggtaactaccgaaggacctaaacggaaaaccgtacgggacctaaccggtacccttaacctaaaacgtcgtactaccttaagtttaccggacggacctaacgttacccggttacccgggggtaacggttccccggggtacctacggtaccgttacgttcggaggttcggacgtacggtaccgggtcgtacggaactacgttactacgtactcggtaccaacgtacgtacaaccgtacgtccgtagaccgtaggtcgtaggacggttagtcgggttacggtactttaacttttacggtactacggtacctaaggtaccgtttaaagtttacttaaacgttacccgttaacccgttccgtaacggttcccggtacggggaaacccgtaaccggggtaaacggttaacgggttaaacgtaaacccgtaagaaaacccggttgtaccggttaccgtaaccggttacgaacccggtaacttacggttaccgttaccgtaaacctttcccgggtaacctttaccccgttacccgtctaaacgttccctaaacgg

SEQ ID NO: 169519 - DNA, 847 bp, Homo sapiens
  misc_feature: GYAE6OF01AUAE5.37.11.A11.1.454.CMB.1.raw
  modified_base (231)..(231): a, c, t, g, unknown or other
  misc_feature (231)..(231): n is a, c, g, or t
tcagtagtgtagatcacgaccggtgctcgatttagctacgactgcaggggcagcaagatggtgttgcagacccaggtcttcatttctctgttgctctggatctctgggtgccgtacggggacaccgtgatggacccagtctccagactcccgtggctgtgtctcgtcggggcgaggacgggcctacccatccaactcggacaacggtccagcccaggtaccttgttttaanacagtcctaccaaacgtaataaacgtaactacttacggtcttggtactcgagaccgaaggaaacccgagggtaccacggacccttaccgtaaacgttcgaccttcgttaagttttaccggcgggtaccgtatacccggtacccggggtaccggttcccggggtacccgtacggtaaccgtaacgtttcggaagggtcgggaccgtacgggtccggggttacggtacgggaacgtaacgttacgttttaaccccgaccttacccgtaccgtaaccctaacgttaacccgaaaccgtaccggtacccgtacggaccggtacggggtacggtacgggtaagggtaacgtttacggggtcggttaccgtttaagtttttaacttacccggttagttaccgaaggttacgtaacggtttatttaaccgttaaacgtttacccgtacccgttacccggtacccggtaccggtacccgggtaacgggtaacgtaacgggtaacggtaaacgtaccgtaaaacgtacggtgtaaccgggtacctagggtaccctaccgttaacgtcccggtttacgttacttcccgtaactttcccgttacccgccttagttcccggttaaacg

SEQ ID NO: 169520 - DNA, 745 bp, Homo sapiens
  misc_feature: GYAE6OF01DDW4Z.37.11.A11.1.454.CMB.1.raw
  modified_base (589)..(589): a, c, t, g, unknown or other
  misc_feature (589)..(589): n is a, c, g, or t
  modified_base (631)..(631): a, c, t, g, unknown or other
  misc_feature (631)..(631): n is a, c, g, or t
tcagtagtgtagatcacgaccggtgctcgatttagctacgactgcgaggggcagcaagatggtgttgcagacccagtcttcatttctctgttgctctggatctctggtgaccgtacggggacaccgtgatcgacccagtctccagacctccctggctgtgtctcgtgggcgaggacgggcctccactacaacgtcgacaacgtccacgccagtacttagtttaacgaactacgtacctaaccaaactaaagtaaagtaacctttaacgttagtacgttaggtactacgaacgtacgaaacgaaaccggagggacctaaccgtcccctaaccgttaaactccgtacttacgttaacgtttcggtaccggtacctacgtaccccgggtaacccggggtccggggttaccccgggtaccccgttacggtacccgttaacttccggaggtacgggtaccgtacgggtacgggttaccggcggtaactaacgttaccttcctaaccttcctaaccgtacctaacgtactacccgaactcgtacgacgtacggtagtcgggtaaggtagttcgtaggttacgttatttacgtacngtacgataccgttagtattacctactcccgttactaccgggngtaccggaacgaacgggtaccgaaggttaacgaacacgtaagtacgtgtaccgtctagaccctacgttattcgtacctgttacccgtctaccccgttaccacttgtaccgtaac

SEQ ID NO: 169521 - DNA, 528 bp, Homo sapiens
  misc_feature: GYAE6OF01BMQNR.37.11.A11.1.454.CMB.1.raw
  modified_base (286)..(286): a, c, t, g, unknown or other
  misc_feature (286)..(286): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (414)..(414): a, c, t, g, unknown or other
  misc_feature (414)..(414): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttttatacagctccaacaataagaactacttagcttggtatcagcagaaaccaggggcagcctcctaaaactgctcatttacngggcatctacccggagtccgggtcctgaccgattcagtgcagcggtctgggacagatttcactctcaccatcaaacngcctgcaggctgagatgnggctatttatactgtcagcagtattataatacncctacgacgttcggaccaaggggaccaagggtaggaaatacgaaaacgtagtagtggactgccactagtcctgttccttcgtaacttcccttaccccgacctagttccgtaacg

SEQ ID NO: 169522 - DNA, 846 bp, Homo sapiens
  misc_feature: GYAE6OF01AIBNY.37.11.A11.1.454.CMB.1.raw
tcagtagtgtagatcacgaccggtgctcgatttagctacgactgcaggggcagcaagatggtgttgcagacccaggtcttctatttctctgttgctctggatctcgtggtcgccgtacggggacaccgtgatcgacccagtctccagacctcccgtggctgtcgtctcgtgggcgaggacggccctacatacaactgactaagttcacgactaagtacttagtttaatacacgtacctaaccaaaacgtaaataaacgtaaaccttacgttacgtacgttaggtaactacgaacgtaaccgaacggaaaaccgcggaccaaccgtacccttaacctaaacgtcgtaccgttacttaacgtttccggacggtacctaacggttccccgggtaaccccggggttacggttccccggggtacccctacgggtaaccgtacgttacggagtcgggtacgaccggggtccgggttaggtaacgggaacctaaggtttaccttacccgtaactaccgtacctaaccgtaactaccaaccggacgtccggacgtacggtacggtacgtaggtaacgtgtacggttacggtacttttattaacgtctaggtacagtaccttagttaacctaacgtaccttacgtacccgtcggttaaccgtaccgggaaaccgtaaaggggtaaccgttaaaggtaaacgtaaaccgtaaccgttaaaacggtcggttccgggttaaccgacccggtaccgaaaacccttaccggttaacgtttcccgtttacccgtttaacccgttactttacccccggttaaacccgttaacgttaccccttaagggttaacccttaaaccg

SEQ ID NO: 169523 - DNA, 777 bp, Homo sapiens
  misc_feature: GYAE6OF01A7PFD.37.11.A11.1.454.CMB.1.raw
tcagtagtgtagatcacgaccggtgctcgatttagctacgactgcgaggggcagcaagatggtgttgcagacccaggtcttcatttctctgttgctctggatctcgtggtcgccgtacggggacattcggtgtactcgaccctaggtcctaccacgaccttcccgtgggcgttgtcgttcgtcgtggggacgaaggcgggacccactaactacaactcgacaacgtccacggtaccagtactttcgttttcgtacagtcgtaaccaaacgtaaataaactaacgtttactttacggcctttacggaaacaacgaagaacgacgtaacggaccacgtccttacgtacgttcgccttattactttacgcggccaccgtcccgaccgggtcgtccggtacccgggtcctacggacgtactacggcgcggacgtacggtcgggtcgacggactacgtacttcacgtctaaccgaccgtacactaacaccggtctaacggcgtaccggtacgttaacgggagggttacgtcggttaacggttacgtttaacgtttacgtacgttagtaccgtacggttaatactttaaacgttaacttaactacccggttccggttaacccggtacggtaccggaaccgtaacgggaaccgtaaggtaaaccggtaagtaaccgaaaccggtacggtacgttcggtccgacggttaaccctgttaaccgttcgtttaccggtaacccctttgtaacccctttaaccccggcctaccttaaccgtttaaaccg

SEQ ID NO: 169524 - DNA, 624 bp, Homo sapiens
  misc_feature: GYAE6OF01C5EOX.37.11.A11.1.454.CMB.1.raw
  modified_base (172)..(172): a, c, t, g, unknown or other
  misc_feature (172)..(172): n is a, c, g, or t
  modified_base (213)..(213): a, c, t, g, unknown or other
  misc_feature (213)..(213): n is a, c, g, or t
  modified_base (452)..(452): a, c, t, g, unknown or other
  misc_feature (452)..(452): n is a, c, g, or t
  modified_base (616)..(616): a, c, t, g, unknown or other
  misc_feature (616)..(616): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgaggnggcctccatcaactgcaagtccagccagtacttgttttaanacagctaccaaacaattaacgaacttattacgctttggtatcagacaaggaaaccgtgggccacgtccctacctaaactcgacttctatttacgtgggctacgccgtaccgggagtccgggcctggacccgtattcgaggtcgcgtacgggtcgggtcctagggactaacgtcgtttacctactctaccaacctaactccaaagtcgctagacgtggctaggaggtacgtggtacggtnttaatttatacgtcgactagcttaagtattaactaattcctccgtacggtacgttcggaaccgaggaccgtaaggtaagtaaacgtacgaaacgttacgcgggttcgcgtaccgctaactcttccggttcttaccctttacgaccctttcccgtccaaccgttntacgtacg

SEQ ID NO: 169525 - DNA, 782 bp, Homo sapiens
  misc_feature: GYAE6OF01AZOKS.37.11.A11.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (335)..(335): a, c, t, g, unknown or other
  misc_feature (335)..(335): n is a, c, g, or t
  modified_base (484)..(484): a, c, t, g, unknown or other
  misc_feature (484)..(484): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatcgacccagtctaccagtacctccctggcttgtcgtctcgtggcgaggacggccctcatcaactgactaatcccacgccagtctttgttttaanacgacgcctaaccaaanaacgtaacgtaacttacttaagtgttaggtactccgagaccgaaggtaaaccggaggtccacgtcccttaactaacgtgccttacgtaatttccggnggtaccacgttcccggtaacccgggtcgggtcccgggtacctacgggtacctgttaccgaggttcggacgtaggtccgggttcgacggtactagtaccgttccacctcctaaccgacctacgtactacccgacgtcctacgcgtacggngtaggacgtcgttggtacggttactttaagtttctaccgtttacgccttaacgtcttaaagtttactaacgtttaccctcccgttaacccgtttaccgggtaccgggttaccgaaacccggttaacgggacgtttaaaacgggttactaaaccgggtaaacacccggttaaaggttccgggtaacgtacccgtaaggtacccccttaaggttaccgttttccggttaacgttaaccccgtttttccggaaacccttttccccggaacccgttacctaaacgttttcggtaaaaccccc

SEQ ID NO: 169526 - DNA, 863 bp, Homo sapiens
  misc_feature: GYAE6OF01A9AAR.37.11.A11.1.454.CMB.1.raw
  modified_base (222)..(222): a, c, t, g, unknown or other
  misc_feature (222)..(222): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctcctggctggtgtctcgtgggcgaggacgggcctccatacaactgacaacgtccacgaccagtacttgttttaanacacgcctaccaaaactaaataaacgaacttacttagtcttaggtatacagacaacggaaaccagggcacgtccctaactaactgaccttactaatttcggcggctaacgtcccggtaacccggggtacggttccccgggtaccgtacggacctagttccgtagggtcgacggtagggcgggtacgtagggaactaggtactttcccgactccctacctaaccgtactaaacccgacggaccgttcgtaccggacggtacggtacggtagacgggttaacgttaggttaccgggtttaacgtttaaacgttttaacgttacgttaaacggtaccgttaaacggtaaccgtttaaaagttttaacgtttaaaaccggttaaaccttttaccccgtttaacccccggggttacccggtaaaccccgggttacccgggtaaacccgggtaaacggggtaaacccggtaaacggggttaaaaccgaaaccggttaaaccgtaaaaaccggttacggtacgggttacggtaccgttaaccccggtaaaccttaacccggttacgttacccggttaccgtttacccgttacccttaccccggttaccccccttaaccccggttcttaaaccgtccggttaaaccccc

SEQ ID NO: 169527 - DNA, 736 bp, Homo sapiens
  misc_feature: GYAE6OF01AV7T3.37.11.A11.1.454.CMB.1.raw
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (512)..(512): a, c, t, g, unknown or other
  misc_feature (512)..(512): n is a, c, g, or t
tcagtagtgtagatcacgaccggtgctcgatttagctacgactgcaggggcaggcaagatggtgttgcagacccaggtcttcatttctctgttgctcgtggatctctggtcgccgtaccggggacaccggtgatcggaccccagtcctccagacctcccgtggctgtgtctcgtcgggcgtagacgggccctcagtcaactggcacgtccagccagtacttgttttacacagcctaccaaacgaactaacgaaccttacgttagtcgttagtacacgtagactaacggaaccgagggtccaccgtacccttactaaccgtntactactactttacggnggtacctacgttcccggtaacccgggtcggtcccgggtacctacggacccgtagtcggtagttcggacgtcgggtccggttaccggtacggtacgtacttatcccggtacctacctacctaacctactacaaaccgtcggcctacggtaccgagtccgggtaaggtacggttancgggttacgttacgttacgttttaaccgtcggttacggtacgacgtttaccgtaaacgttttacgtaacctttacgtaacccttcccggttaacggtaacccggtccgaaccgggtaacgtacggacggttaacgaacgtaactaacggacgtggtaacgcgtcctagtaccagtcgttccgttccttagttcccacccgttcccacgttcgtaaacccgttcg

SEQ ID NO: 169528 - DNA, 796 bp, Homo sapiens
  misc_feature: GYAE6OF01B47Z4.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgaccagtctcagacctccgtggtctgtgtctcgtgggacgaggacggcctaccatacaacgtgactaacgtccgagaccaaggtactttagttttaacacacgtacctaaccaaaactaaataaacgtaaaccttacgttacgtacgttaggtactacaacgacgaaacgaaaccggaggacaacgtacctaacctaaacgtcgacctacgttaacgtttacgacggacgtaccgttaccggtaacccggggtaccggttcccgggttacctacggtaaccgtagtttaccgaggtacggacgaacgggtcgggtacggtaggaactacgtacttaccgacttaccaccacgtaactacgaaactacggcctacggacgtaacggtacgtaggtaacggtacgtaggtacggttaacgtttaactttaacgttcgtacgtacgaacggttaactaacgtttaaatttaactaaaccgttacccgtacccgtttaccggaaccgggttaacggaaccggtaacgggtaacgtaaaggaacggtaaactaacggtaaacgtacgtaagggtcgtaaaccgacgtaaccctaacgtacgttacgtacggtttaacccttacctaaccggtttccccttaacccggaacttaaccgtaacggttaaaccg

SEQ ID NO: 169529 - DNA, 762 bp, Homo sapiens
  misc_feature: GYAE6OF01AWCAJ.37.11.A11.1.454.CMB.1.raw
  modified_base (221)..(221): a, c, t, g, unknown or other
  misc_feature (221)..(221): n is a, c, g, or t
  modified_base (716)..(716): a, c, t, g, unknown or other
  misc_feature (716)..(716): n is a, c, g, or t
tcagtagtgtagatcacgaccggtgctcgatttagctacgactgcaggggcagcaagatggtgttgcagacccaggtcttcatttctctgttgctctggatctctggtacccgtacggggacaccggtgatcgacccagtcctccagacctcccgtggctgtgtctcgtgggcgaggagggcctcgatccaactgacaagtccagccagtacttgtttaanaccgagtcctaccaaactaagttaaacgaaaccttacgttaacgcctttaggtactaccgaacgacgaaaccggaaaaccgtaggggacctacgtacccttaaccgtaaacgtcgtactacgttaactttaccggtacgggaccttaccgtaccggtaccccggggtacggttcccgggtaccctaggaacccgttatcggaggtacgggcctaacgggtcgggtaccgtacggggtaacctagtttaccttaccgaccttccggtaaccaacgtaactacccgaacgtacggtccccgtagggaaccgacggttacgtaagggtacgtacggttaggttacgtacgtttatttacggtacgtcgtacgtagtacgttaacgtttattaaccgtaacttcctaccggttaccgtacggttaccgaacggtaacgggtactaaggtaacgtaaacgtacgtaaacgcgtcggtacgtcctacggacctacgttacncgttcttccgtacgaaccttccgtacccatacttcgtacttaaccg

SEQ ID NO: 169530 - DNA, 994 bp, Homo sapiens
  misc_feature: GYAE6OF01BZ2Q4.37.11.A11.1.454.CMB.1.raw
  modified_base (93)..(93): a, c, t, g, unknown or other
  misc_feature (93)..(93): n is a, c, g, or t
tcagtagtgtagatcacgaccggtgctcgatttagctacgactgcaggggcagcaagatggtgttgcagacccaggtcttcatttctctgttnctctggatctctggtgccgtacgggacaccgtgatcgacccagtcctccacgacctcccgtggctgtgtctcgtgggcgaggacggtcctcagtacaactcgacaacgtccacgccgtaagtactttaggttttaactacgacgtccttaccaaacgtaaaacttaaacgaaacctttacttaacggtcgtttacggtaactccacggtaaccgaaaccggtaaaacccgtacgggtaccgaaccgttacccctaaccgttaaaaccgtcgtacctttacgttaacgtttaccgtacgggtacctaaccggttaccccggttaaaccccgggggtcgggttaccccggggttacccgttacggtaacccggttaactttcccggtaacggggtccggaccgtaaccgggggttaccgggttaccggtacggggaaaccttacgggtttaccgtttacccgaaccgttttaccccgtaccaaaccgtaccgtaccttaaaccggaccgtttacccgaacggtacccggtaccgggttaaccttgggggtaaagggtttaccggtaacgggtttcgggttaaaacgttttaacgttttaaacggttacccgtaccggttaacggtaacccggttaacgttaaacggttttaaacgttaaacccttaacgtttaacccccgttacccccggtttacgggtaacccgggtttacccgggaaaccggtaaaaccgggttacgggtaaacggtaaacggtaaacctaacccggtaaaaccgggtgttaccgggttacccgtaccgtaacgtaacccgttaacccgttacggttcccttaccggttacccttttaaccggaccgtttaccccgtttacccccggaaacttacggttttccggtaaacc

SEQ ID NO: 169531 - DNA, 890 bp, Homo sapiens
  misc_feature: GYAE6OF01D358S.37.11.A11.1.454.CMB.1.raw
tcagtagtgtagatcacgaccggtgctcgatttagctacgactgcaggggcagcaagatggtgttgcagacccaggtcttcatttctctgttgctctggatctcgtggtcgccgtacgggacaccgtgatcgacccagtctccacgacctccgtggctggtcgtcctgtcgggagaggacggtcctactagtaccgaacgtcgactaacgccgacgaccgtagttacgtttagttttaacgaaccgtaccgtaccctaaaccgtaaaacgtaaaacgttaaaaccgtaaccttaccgtttaggttacgttacgtaactacgaacggaaccgaaaaccggaaccggagggaccctaccgtacccttaaccgtaacgtcgtactacgtacgtttacggcggtacgtaccggttacccgggtaccggggtacccggttcccgggtaccttacggtaccgtacgttacggacgggtaccggtaccggtagggtaccgggggttccgaagggtaacctaacggtttcccttaaccaaccctttccaaaccccggtaaccttaacgttaccggaaaccggtccgtacccgtacggaccgtacggggtacggtaagggtaccggtaaggtttcgggttacgttaaacttttacgtttaacggtcgtacccggtagtactaaacggttaactttaacgttaaccgttaacccgttcccgtaccggttacccgggtacccggttaaaccggggacccggaaaaaggggtaccggtttaaacgggaaactaaaacccgggacgtttaaaggccggttacggccttacgacccgtactaacccgggttctaacgttcgtttacccaccggtttaccctccaacccttactgtacggtaacc

SEQ ID NO: 169532 - DNA, 832 bp, Homo sapiens
  misc_feature: GYAE6OF01BN5E0.37.11.A11.1.454.CMB.1.raw
  modified_base (221)..(221): a, c, t, g, unknown or other
  misc_feature (221)..(221): n is a, c, g, or t
tcagtagtgtagatcacgaccggtgctcgatttagctacgactgcaggggcagcaagatggtgttgcagacccaggtcttcatttctctgttgctctggatctctggtgacctacggggacaccgtgatgacccagtctccagacctcctggctgtgtctcgtgggacgaggacggcctacctatacaactgacaagtccagccagtaccttggttttaanaccagtcctaccaaactaaagtaacgtaaccttaccgttaggtctttagggtaacttaccgaacgtaccgtaaacggaaaccgtacggggtaccacggtaccccttaacccgttaaaacgttcgtacccgttacgttaaccgttttaacggcggggtacctaaaccgtttacccggttaacccccgggggtaaccggtttcccggggggttaccccttaacgggtaaccccgttagtttaaccccggaaggtttaccggggaccgtacgggtacccggggttaccgttacgggaacctaaagggttacctttacccgaaccgtttaccacccggtaacctaaccgttaaaccgaacctaccggtaccccgttacggacgtaacgggtccgttaggaacgggttacgtacggtcggtacgttaacttttacttaccgttagtaccgtaacgtaccgtagttaacgttaacttaaaccttaccgttacccgtcccgttaacggttaccggtaacccgtaagggaacccgttaaggaacgtaaactacgaaaccgtcgtagtacgacgtcgacctacgacttcacgttcactacctcgtaccccatctcgtacg

SEQ ID NO: 169533 - DNA, 811 bp, Homo sapiens
  misc_feature: GYAE6OF01A28CW.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacgggacaccgtgatcgacccagtcctccacgacctccctggctgtcgtctcgtgggacgaggacgggtccctccatacaacgtcgacaagtccacgccagtactttacgttttacacgacgtacctaaccaaaactaaactaacgtaacttacgttagtacgtttacggtaatacgaacgacgaaacggaaaccggacggactacgtaccctacctaaacttcgtaccttacgtaacgtttcgtacgggtacctacgttacccgggacccggggtccgggttcccgggtaccctcggtaccgtacgttcgacggtcggcgtacgggtccggttacgacgggtacacgttacttacctactacctaccgtaaccgtactaaccgacgtacgccgtaggaccgtagggtcgtaggaacgttcgtacgggtaccggttaatttaacgtttaacttacggtacctagtaaactacggttaatttaacgtaacctttaccgtacccgttaacccgtaccgggttaacccgggtacggaacccggttaaacggggaacggttaaacgggttaacgaaaccgtaaccggaaaccggttcggtggttaaccggacctaaccggttaccctaacgttacgtttccggttaccgtttaccctttcggaacccctttcccgaaccccgttcgtaattcccggtaaacc

SEQ ID NO: 169534 - DNA, 757 bp, Homo sapiens
  misc_feature: GYAE6OF01EKPA1.37.11.A11.1.454.CMB.1.raw
  modified_base (51)..(51): a, c, t, g, unknown or other
  misc_feature (51)..(51): n is a, c, g, or t
  modified_base (94)..(94): a, c, t, g, unknown or other
  misc_feature (94)..(94): n is a, c, g, or t
tcagtagtgtagatcacgaccggtgctcgatttagctacgactgcaggggnagcaagatggtgttgcagacccaggtcttcatttctctgttgntctggatctctggtgccgtacggggacaccgtgatgacccagtctccagaccttccctggctgtgtctcgtggggcgagacggccctccatcaactgcaagtccagccagtacttgttttaactaccagtacctacccaagaaataacgtaaaccttacttagacgtttaggaatcaagaccgaacgaaaacccgacgggtaccacgtaccctaccgtaaaactcgtcctacttaacgttttaacggcgggactacgttacccggtacccggggacggttcccggggtccctacggacccgtattcgaggtcggcagggtccgggtcgtaggactagtactttcacgttccgaccacctacgtaacaacgactccgtagccgagtccgtagggaaggtagttcggtaacggttacttaagtttttacgtacgtcggttactaacgtaacgtttaagtaaccttttaacgttaaattccccgtttacccgtaaccgggttacccggttaaccgggccgggaaaaggggttaacccgaagggttaacgaaacctaacggaaaaccgtacgtttgggaacgtccgtaggtcccaacgtactttccgggttacttaaccgtttcccgaacttttccccgtaaccccgttacctacgttccgttaacg

SEQ ID NO: 169535 - DNA, 497 bp, Homo sapiens
  misc_feature: GYAE6OF02I0CJ2.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccacgacagcctcctaagctgctcgtttactgggcctctacccgggaatccggggtccctgaacgattcagtggcggcgggtctgggacagattcactctcaccatcagcagcctgcgggctgaagatgtggcggtttattactgtcagcagtattatgttactcctcactagtttggccagggaccaagctggagatcgcacgactgtggctgcaccatctgtcttcacttcctcccgccatcg

SEQ ID NO: 169536 - DNA, 505 bp, Homo sapiens
  misc_feature: GYAE6OF02IXVZ0.37.11.A11.1.454.CMB.1.raw
tcagtagtgtagatcacgaccggtgctcgatttagctacgactgcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttctttagcttggtaccagcagaaaccacgacagcctcctaagctgctcgtttactgggcctctacccgggaatccggggtcctgaacgattcagtggcggcgggtctgggacagatttcactctcaccatcagcagcctgcggctgaagatgtggtcggtttattactgtcagcagtattatgttactctcactagtttgccagggaccaagcgtggagagtcgcacgactgtcggctgcaccatctcgtcttcatccttcccgcctac

SEQ ID NO: 169537 - DNA, 492 bp, Homo sapiens
  misc_feature: GYAE6OF02GRD1L.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagtggtctggacagatttcactctcaccatcaacagcctgcaggctgaggatgtggcgatttattactgtcagcagtattataatctcctcgacgttcggccaagggaccaaggtgaaatcaaacgactgtgctgcacatctgtcttcatccttccgctatctag

SEQ ID NO: 169538 - DNA, 499 bp, Homo sapiens
  misc_feature: GYAE6OF02JBILH.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgtaggctgaggatgtggcgtatttatactgtcagcagtattataatactctccgacgttcgaccaggaccaaggtgaaatcaaacgactgtgctgcacatctgtcttcacttccttcccgcactctgtaac

SEQ ID NO: 169539 - DNA, 497 bp, Homo sapiens
  misc_feature: GYAE6OF02HDMPE.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttattactgtcagcagtattataatactcctcgacgttcggccaagggaccaaggtgaaatcaaacgactgtgctgcaccatctgtcttcatccttcccgctatctacg

SEQ ID NO: 169540 - DNA, 564 bp, Homo sapiens
  misc_feature: GYAE6OF02IO4UC.37.11.A11.1.454.CMB.1.raw
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
tcagtagtgtagatcacgaccggtgctcgatttagctacgactgcaggggcagcaacgatggtgttgcagacccaggtcttcatttctctgttgctctggatctctggtgcctacgggacaccgtgtagtgacccagtcttccagactccctggtctgtgtctctggcgagaggcctccatcaactgcgaagtccagccagactggtttatacagctccaacaataacgaactacttagcttggtatcgtagcagaaacccagggccaaggcctcctaaactgctcgatttactgggcatctacccggggatccggggtcctgaccgattcagttggcagcgggctggacngatttcatctcaccatcaacngcctgcaggctggagntgnggctaatttactagtcgcagctaagttattaataactacctccgtccgtaacggtttccgacgaaagggacctaagggtacgtaaaactccgaaaacgtacgtggtaggcgtacggacctaaccgattctacgttacttaccgtattacccgttccccgacgtactcgtaacg

SEQ ID NO: 169541 - DNA, 499 bp, Homo sapiens
  misc_feature: GYAE6OF02IZNVK.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcggtctggacagatttcactctcaccatcaacagcctgcaggctgaggatgtggcgatttattactgtcagctagttattataatactcctccgacgttcggaccaagggaccaaggtgaaatcaaacgactgtggctgcaccatctgtcttcattcctcccgctatctag

SEQ ID NO: 169542 - DNA, 498 bp, Homo sapiens
  misc_feature: GYAE6OF02GFU02.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttattactgtcagcagtattataatactcctcgacgttcggccaagggaccaagggtgaaatcaaacgactgtggctgcaccatctgtctcactccttcccgcatctag

SEQ ID NO: 169543 - DNA, 498 bp, Homo sapiens
  misc_feature: GYAE6OF02F2DHN.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagatttcactctcaccatcaacagcctgcaggctgaggatgtggcgatttatactgtcagcagtattataatactcctccgacgttcggccaagggaccaagggtgaaatcaaacgactgtgctgcaccatctgtcttcatccttcccgcctatctag

SEQ ID NO: 169544 - DNA, 493 bp, Homo sapiens
  misc_feature: GYAE6OF02G592T.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacatcgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttatactgtcagcagtattataatactctccgacgttcggccaagggaccaaggtggaaatcaaacgaactgtggctgcaccatctgtcttcatctcccgcatc

SEQ ID NO: 169545 - DNA, 482 bp, Homo sapiens
  misc_feature: GYAE6OF02JUSI8.37.11.A11.1.454.CMB.1.raw
  modified_base (452)..(452): a, c, t, g, unknown or other
  misc_feature (452)..(452): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcatttactgggcatctacccgggagtccgggtcctgaccgattcagtggcagcgggtctggacagattcactctcacatcaacagcctgcaggctgagatgtggcgatttatactgtcagcagtattataatactcctcgacgttcgccaagggaccaaggtgaaactcaaacgactgngctgcacatctgtctcactctccgcatctg

SEQ ID NO: 169546 - DNA, 578 bp, Homo sapiens
  misc_feature: GYAE6OF02H7JPK.37.11.A11.1.454.CMB.1.raw
  modified_base (286)..(286): a, c, t, g, unknown or other
  misc_feature (286)..(286): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (546)..(546): a, c, t, g, unknown or other
  misc_feature (546)..(546): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaaactgctctatttacgnggcatccgtaccgggacgtccgggtcctgaccgtattcgaggtggcaggcgggtcgtaggactagtattcactctacaaccntacaacncgcctgcgaggctggaggtatggtcggacgttaatttattactgtacagcttagttattaagttaactaccttcccgtaccggtaccggtttaccgggacctaaacggggacctaaagggttacgaaaactacgaaaacgtacgtggtacggctggccaacctatccgttntcttcacttcccttacccgacttactctaacg

SEQ ID NO: 169547 - DNA, 502 bp, Homo sapiens
  misc_feature: GYAE6OF02FXDUU.37.11.A11.1.454.CMB.1.raw
  modified_base (492)..(492): a, c, t, g, unknown or other
  misc_feature (492)..(492): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgagatgtggcgatttatactgtcagcagtattataatctcctccgacgttcggccaagggaccaaggtgaaatcgaaacgaactgtggctggcaccatctgtcttcactccttcccncctatctacg

SEQ ID NO: 169548 - DNA, 488 bp, Homo sapiens
  misc_feature: GYAE6OF02ITUIK.37.11.A11.1.454.CMB.1.raw
  modified_base (359)..(359): a, c, t, g, unknown or other
  misc_feature (359)..(359): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctcaacaataagaactacttagcttggtatcagcagaaaccagggcagcctcctaaactgctcatttactgggcatctaccgggagtccgggtcctgaccgattcagtggcagcgggtctgggacagattcactctcacatcaacanctgcaggctgaggatgtggcgtatttatactgtcagcagttattataatactcctcgacgttcgccaagggccaaggtgaaatcgaaacgactgagctgcaccatcngtntcatcctccgctatctacg

SEQ ID NO: 169549 - DNA, 495 bp, Homo sapiens
  misc_feature: GYAE6OF02HRLK7.37.11.A11.1.454.CMB.1.raw
  modified_base (410)..(410): a, c, t, g, unknown or other
  misc_feature (410)..(410): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttatactgtcagcagtattanaatctcctcgacgttcggccaagggaccaaggtgaaatcaaacgactgtgctgcaccatctgtcttcatccttcccgctatctag

SEQ ID NO: 169550 - DNA, 539 bp, Homo sapiens
  misc_feature: GYAE6OF02JIV7B.37.11.A11.1.454.CMB.1.raw
  modified_base (213)..(213): a, c, t, g, unknown or other
  misc_feature (213)..(213): n is a, c, g, or t
tcagtagtgtagatcacgaccggtgctcgatttagctacgactgcagggcagcaagtagtggtgttgcagacccaggtcttcatttctctgttgcgtctggtagtctcgtggtgcctacgggacaccgtgatgaccagtctccagactccctggctgtgtctctgggccgagagggccttcatcaacgtgcaagtccagccaggactgtttanacgagctcaactaataagaactacttagcttggtaatcagcagaaaccagggcagcctctaaactgctcattactggacatctaccgggatccgggtcctgtacgattcagtggcagcgggtctgggacaggatttcactcgtcactatcgaacagccgtgcaggctgagatggtgacgatttatactagtctagcctagtatttagtaatactccgtacgaacgttcgaccaaggggacccaaggttcggaaatcgaaacgtactagtgggctaggcctacctaatccgtgtaccttcaattcccttaccggcctagtccttacg

SEQ ID NO: 169551 - DNA, 496 bp, Homo sapiens
  misc_feature: GYAE6OF02JT6EW.37.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (334)..(334): a, c, t, g, unknown or other
  misc_feature (334)..(334): n is a, c, g, or t
  modified_base (467)..(467): a, c, t, g, unknown or other
  misc_feature (467)..(467): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttacngggcatctacccgggagtccggggtcctgaccgattcagtggcagcggtcnggacagatttcactctcaccatcaacagcctgcaggctgagatgtggctatttatactgtcagctagtattataatctcctccgacgttcgccaagggaccaaggtagaaactcaaacgactgtgctagcacntctgtcttcactccttcccgctatctacg

SEQ ID NO: 169552 - DNA, 500 bp, Homo sapiens
  misc_feature: GYAE6OF02HA4R4.37.11.A11.1.454.CMB.1.raw
  modified_base (284)..(284): a, c, t, g, unknown or other
  misc_feature (284)..(284): n is a, c, g, or t
  modified_base (475)..(475): a, c, t, g, unknown or other
  misc_feature (475)..(475): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttacnggcatctacccgggagtccgggtcctgaccgattcagtggcagcgggtctggacagattcactctcaccatcaaacagcctgcaggctgaggatggtgcgtatttatactgtcagcagttattataatactcctcgacgttcgccgaaggaccgaaggtgaaatacaaacgaactgtagctagcacatctntacttcactcttcccgctatctacg

SEQ ID NO: 169553 - DNA, 491 bp, Homo sapiens
  misc_feature: GYAE6OF02IX1JV.37.11.A11.1.454.CMB.1.raw
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccaggcagcctcctaaactgactcatttactgggcatctaccgggagtccgggtcctgaccgattcagtggcagcgggtctggacagatttcactctcacatcaacacgcctgcaggctagacggatgtagcgtatttattactgtcagctagttatataatactctcgacgttcgaccaaggaccaaggtgaatacaaacgatagngctgcacntctgtctcactcctccgctatctag

SEQ ID NO: 169554 - DNA, 501 bp, Homo sapiens
  misc_feature: GYAE6OF02HH9GC.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgtatttatactgtcagcagtattataatactcctacgacgttcggccaagggaccaaggtgaaatcaaaacgactgtggctggcaccatctgtcttcactcctcccgcatctacg

SEQ ID NO: 169555 - DNA, 491 bp, Homo sapiens
  misc_feature: GYAE6OF02HTV6C.37.11.A11.1.454.CMB.1.raw
  modified_base (406)..(406): a, c, t, g, unknown or other
  misc_feature (406)..(406): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggagtccgggtcctgaccgattcagtggcagcgggtctgggacagattcactctcaccatcaacagcctgcaggctgaggatgtggcgatttatactgtcagcagtattanaatctcctcgacgttcggccaagggccaaggtgaaatcaaacgactgtggctgcaccatctgtcttcatccttcccgctatctag

SEQ ID NO: 169556 - DNA, 499 bp, Homo sapiens
  misc_feature: GYAE6OF02G5BIB.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctgggacagatttcactctcaccatcaacagcctgcaggctgaggatgtggctatttattactgtcagtcagttattataatactcctcgacgttcgccaagggaccaaggtgaaatcaaacgactgtggctgcaccatctgtcttcatccttcccgctatctacg

SEQ ID NO: 169557 - DNA, 663 bp, Homo sapiens
  misc_feature: GYAE6OF02G6SFB.37.11.A11.1.454.CMB.1.raw
  modified_base (165)..(165): a, c, t, g, unknown or other
  misc_feature (165)..(165): n is a, c, g, or t
  modified_base (171)..(171): a, c, t, g, unknown or other
  misc_feature (171)..(171): n is a, c, g, or t
  modified_base (212)..(212): a, c, t, g, unknown or other
  misc_feature (212)..(212): n is a, c, g, or t
  modified_base (288)..(288): a, c, t, g, unknown or other
  misc_feature (288)..(288): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtcgtctctggngacggnggtcgtccaagtcgactgacgagtccagccagactgtttanacagctccaacaataagaactacttagcttggatcagcagaaaccagggcagcctctaaactgctcaattttacgnggcacgtccgtaccgggacggtcccggggtcctacggaccgtattcgaggtcggcgaggtcgggtcggtcggacgagtacttctactctactaccactacaacacgccgtcgacgacggcgtacgaggtagtggtggtacgttaactttacgttacgttcgtacgtacgtacgtacgttaattaacttaacttaccttacccgttacccggttaccggttaccggtaaccggtaaacgggtaaccggtaacgggtaacggtaaacgtaaacgtaaacgtaacgtacggtacggtacgtacgtaaccgtaaccgtacgtacgttacgttccgttacgtaccgttacccgttacccgtacccgttaccttacgtacg

SEQ ID NO: 169558 - DNA, 499 bp, Homo sapiens
  misc_feature: GYAE6OF02HSFMQ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccgggtcctgaccgattcagtggcagcgggtctggacagattcactctcacatcaacagcctgcaggctgaggatgtggcgtatttattactgtcagctagtattataatactctccgtacgttcgccaagggaccaaggtagaaactcaaacgactgagctgacacatctcgtcttcactccttcccgctatctacg

SEQ ID NO: 169559 - DNA, 502 bp, Homo sapiens
  misc_feature: GYAE6OF02I8FQA.37.11.A11.1.454.CMB.1.raw
  modified_base (461)..(461): a, c, t, g, unknown or other
  misc_feature (461)..(461): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttatactgtcagcagtattataatactcctcgacgttcggccaagggaccaaggtgaaatcaaacgaactgngctggcaccatctagtcttcattccttcccgcctatctacg

SEQ ID NO: 169560 - DNA, 506 bp, Homo sapiens
  misc_feature: GYAE6OF02GMSAA.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggctatttattactgtcagcagtattataatactcctccgacgttcggaccaagggaccaaggtgaaactcgaaacgaactgtgctgcaccatctgtcttcacttccttcccgctactctacg

SEQ ID NO: 169561 - DNA, 559 bp, Homo sapiens
  misc_feature: GYAE6OF02JUMAU.37.11.A11.1.454.CMB.1.raw
  modified_base (361)..(361): a, c, t, g, unknown or other
  misc_feature (361)..(361): n is a, c, g, or t
tcagtagtgtagatcacgaccggtgctcgatttagctacgactgcaggggcagcaagatggtgttgcagcccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttactgggcatctacccgggagtccgggtccctgaccgattcagtggcagcgggtctgggacagattcactctcacatcaacngcctgcaggctggaggatggtgcgtatttatctgtcagcagttattaataatacctccgtaccgtacgttccggaccgaacgggacctaaagggttacgaaactaccaaaacggtacttgggtacggtacttacggcctaaccacgttcctaggttacctttaccacttcccgttaccccgtacctattcccgtaacg

SEQ ID NO: 169562 - DNA, 506 bp, Homo sapiens
  misc_feature: GYAE6OF02IDTYL.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgtatttatactgtcagctagtattataatactcctccgacgttcggaccaagggaccaaggtacgaaatacgaaacgactgtgctcgcaccatctgtctcactccttcccgctatctacg

SEQ ID NO: 169563 - DNA, 482 bp, Homo sapiens
  misc_feature: GYAE6OF02I9XTI.37.11.A11.1.454.CMB.1.raw
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctggacagatttcactctcaccatcaacagcctgcaggctgaggatgtgcgatttatactgtcagcagtatataatactctcgacttcgcaaggcaagngaaatcaaagaactntggcngcacatctgtcttcatcttcccgcatctag

SEQ ID NO: 169564 - DNA, 579 bp, Homo sapiens
  misc_feature: GYAE6OF02F0201.37.11.A11.1.454.CMB.1.raw
tcagtagtgtagatcacgaccggtgctcgatttagctacgactgcagggcagcaagatggtgttgcagacccaggtcttctatttctctgttgtctctggatctctggtgcctacggggacaccgtgatggacccagtctccagactccctggctgtgtctctgggcgagagggcctccatcaactgcaagtccagccagactgttttatacagctccaacaataagaactacttagcttggtatcagcagaaaccagggcagcctctaaactgactcatttactgggacatctacccggggagtccgggtcctgaccgattcagtgcagcgggtctggacagatttcactctcacatcaacagcctgcagctgaggtatggtgcgtatttatactgtcagcagttaacttataactacctcctccgtaacgttcgggaccaaggggtaccaaggggttcgaaaactccgaaaacggtacttaggtcgggtacccttagggaccctaaccctaagttcccgttacggtttaccctttcgtaactttaccccgtttcccccgcctaacgttccttaacgg

SEQ ID NO: 169565 - DNA, 501 bp, Homo sapiens
  misc_feature: GYAE6OF02JDSLL.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccgggtcctgaccgattcagtggcagcgggtctgggacagatttcactctcaccatcaacagcctgcaggctgaggatgtggcgtatttatactgtcagcagtattataatactcctcgacgttcgccgaagggaccaaggtgaaatcgaaacgactgtcgctgccaccatctgtcttcacttcctcccgcctatctacg

SEQ ID NO: 169566 - DNA, 494 bp, Homo sapiens
  misc_feature: GYAE6OF02F6XZT.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagattcactctcaccatcaacagcctgcaggctggagatgtggcgtatttattactgtcagcagtattataatactcctcgacgttcgccaagggaccaaggtgaaatcaaacgactgtgctgcacatctgtctcacttcctccgctatctacg

SEQ ID NO: 169567 - DNA, 495 bp, Homo sapiens
  misc_feature: GYAE6OF02GK95D.37.11.A11.1.454.CMB.1.raw
  modified_base (467)..(467): a, c, t, g, unknown or other
  misc_feature (467)..(467): n is a, c, g, or t
  modified_base (492)..(492): a, c, t, g, unknown or other
  misc_feature (492)..(492): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccgggtcctgaccgattcagtggcagcgggtctggacagatttcactctcacatcaacagcctgcaggctgaggatgtggcgatttatactgtcagcagttattataatactcctcgacgttcggaccaagggaccaaggtgaaatcaaacgactgtgctgcaccntctgtcttcactcctcccgctactntac

SEQ ID NO: 169568 - DNA, 504 bp, Homo sapiens
  misc_feature: GYAE6OF02F5AKO.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatcctacccgggagtccggggtccctgaccgattcagtggcagcgggtctgggacagattcactctcacatcaacagcctgcaggctgaggatggtggcgtatttattactgtcagcagtattataatactcctccgacgttcggaccaagggacaaggtagaaatacaaacgactgtgctgcacctatctgtcttcacttcctccgcctatctacg

SEQ ID NO: 169569 - DNA, 497 bp, Homo sapiens
  misc_feature: GYAE6OF02HIL5H.37.11.A11.1.454.CMB.1.raw
  modified_base (208)..(208): a, c, t, g, unknown or other
  misc_feature (208)..(208): n is a, c, g, or t
  modified_base (461)..(461): a, c, t, g, unknown or other
  misc_feature (461)..(461): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatcgtacccgggagtccggggtcctgaccgattcagtggcagcgggtctgggacagatttcactctcaccatcaacagcctgcaggctgagatgtggcgtatttatactgtcagcagtattataatactcctcgacgttcgacctaagggaccaaggtgaaatcaaacgactgngctgcacatctgtcttcactccttcccgctatctag

SEQ ID NO: 169570 - DNA, 493 bp, Homo sapiens
  misc_feature: GYAE6OF02G8QRT.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggctatttatactgtcagcagtatatatactcctcgacgttcgaccaagggaccaaggtgaaatcaaacgactgtgctcgcaccatctgtctcattcctcccgcatctag

SEQ ID NO: 169571 - DNA, 501 bp, Homo sapiens
  misc_feature: GYAE6OF02GLARD.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatggtggcgatttatactgtcagcagttattataatactcctccgacgttcggccaagggaccaaggtgaaatcgaaaacgactgtgctgcaccatctgtcttcatccttcccgctatctag

SEQ ID NO: 169572 - DNA, 504 bp, Homo sapiens
  misc_feature: GYAE6OF02HIVHG.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagattcactctcaccatcaacagcctgcaggctgaggatgtggcgtatttattactgtcagctagtattataatacctcctccgacgttccggaccaagggaccaagggtgaaatcaaacgactgtgctgcacatctgtcttcactccttcccgctatctacg

SEQ ID NO: 169573 - DNA, 718 bp, Homo sapiens
  misc_feature: GYAE6OF02HXCXB.37.11.A11.1.454.CMB.1.raw
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
tcagtagtgtagatcacgaccggtgctcgatttagctacgactgcaggggcagacgaagatggtgttgccagacccaggtcttcatttctctgttgctctcggatctctggtgcctacggggacaccgtgatgacccagtctccagactccctggctgtgtctctggcgagagggcctccatcaactgcaagtccagccagactgttttatacagctccaacaataacgaactacttagcttggtatcagcagaaaccnggcagcctctaaatgctcagtttacnggcataccgtaccgggagtccgggtccctagaccgattcagtggcaggcggtctcggacagtactttcgactcgtcaaccgtataccgaaacgacggtccctggaccgtaaggggtcctagggtaacgggttaacttcgggtacgggtaccgttaagtttttaacgttaaccgttggttacccgaagtaccgtaaaggttaacttttaaacgtaaacgtttaccgttaccccgttaccggtaaccggtttaccgggaacccgtaaaacggggtacccgtaaaggggttacggaaaaaccttaccggaaaaaccggtaacgttacggttacgggtacccgtttacggaacccgtaacccgttacgttacccggttacgggttacctttacgtaccgttccgtttaccccccggacgttacgttacccgtaacgg

SEQ ID NO: 169574 - DNA, 500 bp, Homo sapiens
  misc_feature: GYAE6OF02GNXI9.37.11.A11.1.454.CMB.1.raw
  modified_base (482)..(482): a, c, t, g, unknown or other
  misc_feature (482)..(482): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactggtcatctacccgggagtccggggtcctgaccgattcagtggcagcgggtctggacagatttcactctcaccatcaacagcctgcaggctgaggatggtggcgtatttattactgtcagcagttattataatctcctccgacgttcgaccgaagggaccaaggtagaaatcaaacgactgtggctgcacatctgtctcnctcctcccgctatctacg

SEQ ID NO: 169575 - DNA, 555 bp, Homo sapiens
  misc_feature: GYAE6OF02IV265.37.11.A11.1.454.CMB.1.raw
  modified_base (372)..(372): a, c, t, g, unknown or other
  misc_feature (372)..(372): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataagaactacttagcttggtatcagcaagaaaccagggcacgcctacctaaactgctcatttacgtgggcatccgtacccgggagtccggggtcctgaccgattcagtggcaggcggtctgggacagtatttcactctcacatcaacngcctgcaggctggacggatggtggacgtatttattactgtacagtctaagtattaataactacctccgtaccgtacgttccggaccgaaacgggacctaagggtacgaaactacgaaaacgacgtgtgtactagcctaacctatctacgttcttacgacttccgttaccccgactatctaacg

SEQ ID NO: 169576 - DNA, 501 bp, Homo sapiens
  misc_feature: GYAE6OF02GUKS5.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagatttcactctcaccatcaacagcctgcaggctgaggatgtggcgtatttattactgtcagcagttattataatactcctcgacgttcggccaagggaccaaggtgaaatcaaacgactgtggctgcaccatctgtcttcattccttcccgctatctacg

SEQ ID NO: 169577 - DNA, 503 bp, Homo sapiens
  misc_feature: GYAE6OF02IX16M.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagattcactctcaccatcaacagcctgcaggctgaggatgtggcgtatttattactgtcagctagttattataatactcctcgacgttcggaccaagggaccaaggtgaaatcaaacgactgtagctgcaccatctgtcttcactccttcccgctactctacg

SEQ ID NO: 169578 - DNA, 580 bp, Homo sapiens
  misc_feature: GYAE6OF02I3UXO.37.11.A11.1.454.CMB.1.raw
  modified_base (290)..(290): a, c, t, g, unknown or other
  misc_feature (290)..(290): n is a, c, g, or t
  modified_base (388)..(388): a, c, t, g, unknown or other
  misc_feature (388)..(388): n is a, c, g, or t
tcagtagtgtagatcacgaccggtgctcgatttagctacgactgcaggggcagcaagatggtgttgcagacccgggtcttcatttctctgttgctctggatctctggtgcctacggggacaccgtgatgacccagtctccagactccctggctgtgtctcgtgggcgagacgggcctccatcaactgcaagtccagccagacttgttttatacagctccaaacaataagaactacttagcttggtatcagcaagaaaccagggcagcctacctaaactgctcatttacgngggacatccgtacccggggagtcccggggtccctgaccggtattccgagtggcaggcgggtcgtgggacaggtatttcaccttctcactataccaacncgcctgcaggctggaggatggtggacgtatttattactgtcagtctagttattaataactacctacctaccgtacgttccggaccgaagggaccaagggttacgaaactacgaaacgaacgttgtacggacctgacctaaccgtattcctagttaccttactacttcccttacccgctacttcctagtaacc

SEQ ID NO: 169579 - DNA, 499 bp, Homo sapiens
  misc_feature: GYAE6OF02JA9WH.37.11.A11.1.454.CMB.1.raw
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccgggtcctgaccgattcagtggcagcgggtctgggacagatttcactctcaccatcaacacgcctgcaggctgaggatgtggcgtatttattactgtcagctagttattataactacctcctccgacgttcggccaagggaccaaggtgaaatcaaacgactgngctgcacntctntctcatcctcccncatctacg

SEQ ID NO: 169580 - DNA, 499 bp, Homo sapiens
  misc_feature: GYAE6OF02G1Y9L.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagatttcactctcaccatcaacagcctgcaggctgaggatggtggcgtatttatactgtcagcagttattataatactcctcgacgttcggaccaagggaccaaggtgaaatcaaacgactgtgctgcacatctgtcttcattcctcccgctatctacg

SEQ ID NO: 169581 - DNA, 633 bp, Homo sapiens
  misc_feature: GYAE6OF02HPBWS.37.11.A11.1.454.CMB.1.raw
tcagtagtgtagatcacgaccggtgctcgatttagctacgactgcagggggcagcaacgatggtgttgcagacccaggtcttcatttctcgtcgttgctctggatcgtctcggtgcctacggggacaccgtgatcgacccagtcctaccagactccctggcctgtgtctcctgggcgagacgggcctccatcaactgcaagtccagccagactgtttactacagtctccgaacaataacgaaactacttagcttggtatcagtcagaaaccaggacaagaccgtacctaaactgctcattactggactatccgtaccgggtagtccgggtccctggaccggtattcagtggtcaggcgggtctggacagtatttcgactctcaccatcaacacgcctgcaggctgagatgtgtcgtatttacttactgttacagtctagttaacttaataaacttactaccgttaccgtacggtttaccggacccgtaaaggggaccctaaagggttacgaaaagtaccgaaaacgtaacgttacggtacggtacgttacggacctaacccgtacttaccgttacgttaccgtttaccgtaccgtttcccgtttacccccggacccttaccgttccttaacgg

SEQ ID NO: 169582 - DNA, 760 bp, Homo sapiens
  misc_feature: GYAE6OF02H6OUA.37.11.A11.1.454.CMB.1.raw
tcagtagtgtagatcacgaccggtgctcgatttagctacgactgcagggggcagcaaggatggtgttcgcagacccaggtcttcagtttctctgttgctctggatctctggtgcctacggggacaccgtgatgacccaggtcttccgagactccctggcttcgtgttctctgggtacgagacgggcctccatcaactgcagtccagccagacgttgttttatacgacgcgtccggaacaataaacgaacttacttagcttggtatcagtcagaaacctggccagcctaccaactgctctattacgcgggctactccgtaccgggcgtcccggggtcctacggaccgtattccgaggttcgcgtaaggtcgggttcgtagggacctagtactttacgacctttcctacaacctattacctaaaccgtacggtcccgtagacccgtacggtcgttacggaggtaacgtggtacggtaaccgtttattttaacgttaaccgtcggtttacgtaacggttacgttaaagtttaactttaaacgttaaacttacccgttacccgttacccggttaaccgggtttacccggaacccggtaaaccggggtaaacccgtaaaggggtttaaccgtaaaacgtaccgtaaaaaccggtaacgttagggtacggtaccgtaccggaacctaacccgtaacgttaccttaacggtttaccttaaccgttaccttacccgtttaccccggtacttaccggtaccgttaacgg

SEQ ID NO: 169583 - DNA, 519 bp, Homo sapiens
  misc_feature: GYAE6OF02G5SA7.37.11.A11.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaaaaataagaactacttagcttggtatcagcagaaaccagggcagcctcctaaactgctcatttacngggcatctacccgggagtcccggggtcctgaccgattcagtggcaggcgggtctgggacagatttcactctcaccatcaacngcctgcagctgagntggtgcgtatttatactgtcagcagtattataatactcctccgacgttcggaccgaagggaccaaggtagaaatacgaaaacgaacgtgtaggctcgacaaccattctgttcttcacttcctcccgcctatctagtaac

SEQ ID NO: 169584 - DNA, 514 bp, Homo sapiens
  misc_feature: GYAE6OF02GWLPT.37.11.A11.1.454.CMB.1.raw
  modified_base (378)..(378): a, c, t, g, unknown or other
  misc_feature (378)..(378): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctgggacagattcactctcaccatcagcagcctgcaggctgaagntgtgctagtttattctgtctgctagtatttgggtactccgtcggtacttcgcgcgagggaccaagggtggagtactcgaagcgaacgtggtgggtctggccaccgtattctggttccttcgacttcctcccgtacc

SEQ ID NO: 169585 - DNA, 497 bp, Homo sapiens
  misc_feature: GYAE6OF02G06L4.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttatactgtcagcagtattataatactcctcgacgttcgccaagggaccaaggtgaaatcaaacgactgtgctgcaccatcctgtctcactccttcccgctatctacg

SEQ ID NO: 169586 - DNA, 512 bp, Homo sapiens
  misc_feature: GYAE6OF02ICOE4.37.11.A11.1.454.CMB.1.raw
  modified_base (284)..(284): a, c, t, g, unknown or other
  misc_feature (284)..(284): n is a, c, g, or t
  modified_base (508)..(508): a, c, t, g, unknown or other
  misc_feature (508)..(508): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaaccagggcagcctcctaaactgctcatttacngggcatctacccgggagtccggggtccctgaccgattcagtggcagcgggtctgggacagtattcactctcaccatcaacagcctgcaggctgaggatggtggcgtaatttatactgtcagcagtattataatactcctcgacgttcggaccaagggaccaaggtcgaaatcgaaaacgtactgtaggctgcaccatctcgtcttcattccttcccgactactntacg

SEQ ID NO: 169587 - DNA, 498 bp, Homo sapiens
  misc_feature: GYAE6OF02FGWGD.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggatccggggtcctgaccgattcagtggcagcgggtctgggacagatttcactctcaccatcaacagcctgcaggctgaggatgtggcgtatttattactgtcagcagtattataatactcctccgacgttcggaccaagggaccaaggtgaaatcaaacgactgtgctgcaccatctgtcttcatccttcccgctatctacg

SEQ ID NO: 169588 - DNA, 497 bp, Homo sapiens
  misc_feature: GYAE6OF02FWCQW.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggatccggggtcctgaccgattcagtggcagcgggtctgggacagatttcactctcaccatcaacagcctgcaggctgaggatgtggcgatttattactgtcagcagtattataatactcctccgacgttcgccaagggaccaaggtggaaatcgaaacgactgtaggctgcaccatctgtcttcatctcccgcatctacg

SEQ ID NO: 169589 - DNA, 501 bp, Homo sapiens
  misc_feature: GYAE6OF02I7JZX.37.11.A11.1.454.CMB.1.raw
  modified_base (364)..(364): a, c, t, g, unknown or other
  misc_feature (364)..(364): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtcccggggtcctgaccgattcagtggcagcgggtctgggacagattcactctcaccatcaacancctgcaggctgaggatgtggcgtatttatactgtcagcagtattataatactcctccgacgttcgacaagggaccaaggtgaaatcgaaacgactgtgctgcaccatctgtcttcacttccttcccgcctatctacg

SEQ ID NO: 169590 - DNA, 501 bp, Homo sapiens
  misc_feature: GYAE6OF02GBIVU.37.11.A11.1.454.CMB.1.raw
  modified_base (492)..(492): a, c, t, g, unknown or other
  misc_feature (492)..(492): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagatttcactctcaccatcaacagcctgcaggctgagatgtggcgtatttattactgtcagcagttattataatactcctccgacgttcggccaagggaccaaggtagaaatcaaacgactgtgctagcaccatctgtcttcatccttcccnctatctacg

SEQ ID NO: 169591 - DNA, 977 bp, Homo sapiens
  misc_feature: GYAE6OF02IR7Z1.37.11.A11.1.454.CMB.1.raw
tcagtagtgtagatcacgaccggtgctcgatttagctacgactgctagggggtcggagcgaacgatgggtagttgcagacccagggtcgttcactttctctcgttgcgtctggtagtctcctggtcgtccctacgggggacctacccgttggacttagacccagtacctccgagttactccctcggccttagtgtacttcgtcgggcgacgtacggggtccgttccacgttctaacttcgggccaaaggtcccaaggccccaaggacccttccgttttaatacctacggtccgtaccctaaaacgtaaaggtaaacgaaaccttaacgttacgtcgtttaggttattccgtaagtcctaaggttaaaacccgaagggggcccggaaccgggtcccttaccccgtaaaaaccttcggtaccttccaatttttaaccgttacggggacctaattccgtaaccccggggtaacggttaccccggggggtcccccttacgggaaccgggtaacttttcccgaacgggttccggggttcctacgggtccggggtaccgttaggggtaaccaacggggtaacttttacccggaacctttacccttccgtaaaccctaacgtttaaccgtaaaccgtacgggtacccctagggtaccgtaggggtccgtaggtaacgggtaacgttggttacggtacgtttactttagttacctaggtcccgtaggttacggacggttaactttaaccgtaacgttacccgttcccgttacccggggtacgggtttaccccggacccgtaaacgggggaccccttaaagggggtacccggttaaaaccgttccggaaaaaaccggtaaccgttaccgggtaacggggtccctttacgggcccccttaaacccgggtaccttacccgtttcggtttacccgtttacccctaacccgtttcccttacccccggtacccttagttacccgttaacgg

SEQ ID NO: 169592 - DNA, 509 bp, Homo sapiens
  misc_feature: GYAE6OF02HITUV.37.11.A11.1.454.CMB.1.raw
  modified_base (282)..(282): a, c, t, g, unknown or other
  misc_feature (282)..(282): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcatttacngggcatctacccgggagtccggggtccctgaccgattcagtggcagcgggtctgggacagattcactctcaccatcaacagcctgcaggctgaggatggtggcgtatttattactgtcagcagttattaataactactcctaccgacggttcggaccaaagggaccaagggtagaaactcaaacgactgtgctcgcaccatctgtcttcattcctcccgctatctac

SEQ ID NO: 169593 - DNA, 507 bp, Homo sapiens
  misc_feature: GYAE6OF02HR4N8.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatcctaccgggagtccggggtccctgaccgattcagtggcagcgggtctgggacagatttcactctcaccatcaacagcctgcaggctgaggatgtggcgtatttattactgtcagcagtattataatactcctcgacgttcggaccaagggaccaaggtgaaatacaaacgtaactgtaggctagcaccatctgtcttcacttcctcccgctatctacg

SEQ ID NO: 169594 - DNA, 512 bp, Homo sapiens
  misc_feature: GYAE6OF02IOWPJ.37.11.A11.1.454.CMB.1.raw
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagtagtgtagatcacgaccggtgctcgatttagctacgactgcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttcttagcttggtaccagcagaaaccacgacagcctcaagctgctcgttactggcctcgtacccgggagtccgggtccctgacccgattcagtggcagcgggtctggacagattcactctcaccatcaacagcctgcaggctgaggatgtggctatttattactgtcagctagtattanaatcncctcgacgttcgccaagggaccaaggtgaaatcaaacgaactgcgctacgcaacctatcctgtcttacgactccttcccgacctatcctaacg

SEQ ID NO: 169595 - DNA, 505 bp, Homo sapiens
  misc_feature: GYAE6OF02HL4I1.37.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttacngggcatcgtacccgggagtccggggtccctgaccgattcagtggcagcgggtctgggacagattcactctcaccatcaacagcctgcaggctgaggatgtggctatttatactgtcagactagtattataatactcctaccgacgttcggaccaagggaccaagggtgaaatcaaaacgactgtagctgcaccatctgtctcacttcctcccgctatctacg

SEQ ID NO: 169596 - DNA, 510 bp, Homo sapiens
  misc_feature: GYAE6OF02IRIMK.37.11.A11.1.454.CMB.1.raw
  modified_base (217)..(217): a, c, t, g, unknown or other
  misc_feature (217)..(217): n is a, c, g, or t
  modified_base (326)..(326): a, c, t, g, unknown or other
  misc_feature (326)..(326): n is a, c, g, or t
tcagtagtgtagatcacgaccggtgctcgatttagctacgactgcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctactcgtttactgggcctctacccgggaatccggggtcctgaacgnttcagtggcggcgggtctgggacagattcactctcaccatcagcagcctgcgggctgaagatgtggcggtttattactgtcagcagtattatgttactcctcactagtttggccgagggaccaagctggagatcgcacgactgtggctgccacatctgttcttcacttccttcccgcctattcg

SEQ ID NO: 169597 - DNA, 498 bp, Homo sapiens
  misc_feature: GYAE6OF02JI8LL.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttattactgtcagcagttattataatactcctcgacgttcgccaagggaccaaggtgaaatcaaacgactgtgctgcacatctgtcttcatccttcccgctactctacg

SEQ ID NO: 169598 - DNA, 526 bp, Homo sapiens
  misc_feature: GYAE6OF02G2ACV.37.11.A11.1.454.CMB.1.raw
  modified_base (364)..(364): a, c, t, g, unknown or other
  misc_feature (364)..(364): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatcgtacccgggagtccggggtccctgaccgattcagtggcagcgggtctggacagtattcactctcaccatcaacngcctgcaggctgaggatggtggctatttatactgtcaggctagttattataattacctcctaccgacgtttcggaccgaaagggaccaagggtgaaactacaaaacgtacgtgtaggctaggccacctatctgtcttacacttccctcccgcctatcctaag

SEQ ID NO: 169599 - DNA, 548 bp, Homo sapiens
  misc_feature: GYAE6OF02IVVIU.37.11.A11.1.454.CMB.1.raw
  modified_base (363)..(363): a, c, t, g, unknown or other
  misc_feature (363)..(363): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcacgcctacctaaactgctctatttactgggctatccgtacccgggagtcccggggtccctgaccgattcagtcggcgagcgggtctgggacagatttcactcncaccatcaacacgcctgcaggctggaggtatggtggcgtaatttagtactgtacagtctaagttattataactacctccgttacgtacgttccggaccgtaaacgggaccaagggtacgaaactacgaaacgacgtgtcgactagcctaaccagtctcgtcttcacttcctacccgctatctacg

SEQ ID NO: 169600 - DNA, 511 bp, Homo sapiens
  misc_feature: GYAE6OF02HNCQZ.37.11.A11.1.454.CMB.1.raw
  modified_base (491)..(491): a, c, t, g, unknown or other
  misc_feature (491)..(491): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatccgtacccgggagtccggggtccctgaccgattcagtggcaggcgggtctgggacagatttcactctcaccatacaacagcctgcaggctgaggatggtggcgtatttattactgtcagctagtattataatctcctcgtacgttcgacaagggaccaaggtagaaactcaaacgactgtgctgacaccatctagtcttacncttcctacccgctatctacg

SEQ ID NO: 169601 - DNA, 495 bp, Homo sapiens
  misc_feature: GYAE6OF02HGKTS.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctaccgggagtccgggtcctgaccgattcagtggcaggcgggtctggacagattcactctcaccatcaacagcctgcagctgaggatgtggcgtatttatactgtcagcagtattataatctcctcgacgttcgaccaagggaccaaggtagaaactacaaacgactgcggctgcacatctgtcttcacttcctccgctatctacg

SEQ ID NO: 169602 - DNA, 508 bp, Homo sapiens
  misc_feature: GYAE6OF02HD25G.37.11.A11.1.454.CMB.1.raw
  modified_base (365)..(365): a, c, t, g, unknown or other
  misc_feature (365)..(365): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcaggcgggtctgggacagatttcactctcaccatcaacngcctgcaggctgaggatgtggcgtatttattactgtcagcagttattataatactcctcgacgttcggaccaagggaccaaggttgaaactcaaacgactgtgctgcaccatctgtcttactactccttcccgcctatctacg

SEQ ID NO: 169603 - DNA, 488 bp, Homo sapiens
  misc_feature: GYAE6OF02FIXLB.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacatagaactacttagcttggtatcagcagaaccagggcagcctcctaaactgctcatttactggcatctaccggatccgggtcctgaccgattcagtggcagcgggtctgggacagatttcactctcaccatcaacagcctgcaggctgaggatgtggcgatttattactgtcagcagtattataatactcctcgacgttcggccaagggaccaaggttgaaatcaaacgactgtgctgcaccatctgtcttcatcttcccgccatctacg

SEQ ID NO: 169604 - DNA, 516 bp, Homo sapiens
  misc_feature: GYAE6OF02HC6SS.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatctacccgggagtccggggtcctgaccgattcagcggcaggcgggtctgggacagattcactctcaccatcaacagcctgcaggctggaggtatggtggacgtatttatactgtcagctagtattataatctcctcgacgttcggaccaagggaccaagggtacgaaactcaaaacgactggtacgctagcaacctatctgtcttcacttccttcccgactatctacg

SEQ ID NO: 169605 - DNA, 496 bp, Homo sapiens
  misc_feature: GYAE6OF02GX8F2.37.11.A11.1.454.CMB.1.raw
  modified_base (465)..(465): a, c, t, g, unknown or other
  misc_feature (465)..(465): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctctaaactgctcatttactgggcatctacccgggagtccggggtcctgaccgattcagtggcagcgggtctggacagattcactctcaccatcaacagcctgcaggctgacggatgtggctatttattactgtcagtcagtattataatactcctcgacgttcgaccaaggaccaaggtgaaatcaaacgactgtagctgcnccatctgtctcactcttcccgctactctacg

SEQ ID NO: 169606 - DNA, 532 bp, Homo sapiens
  misc_feature: GYAE6OF02IDXQG.37.11.A11.1.454.CMB.1.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
  modified_base (491)..(491): a, c, t, g, unknown or other
  misc_feature (491)..(491): n is a, c, g, or t
  modified_base (527)..(527): a, c, t, g, unknown or other
  misc_feature (527)..(527): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagacctccctggctgtgtctctgggcgagagggcctccatcaactgccaagtccagccagactgttttanacagctccaacaaataagaactacttagcttggtatcagacagaaaaccagggcagtcctacctaaatcgctacatttacngggctactcgtacccgggagtcccgggtccctggacccgattcgagtcggcagcgggttcaggacagatttcacttctacaactntacaaacngcctagcagctgagatgtggactatttatactgtacagctaagtactttaanactactccctcgtacgttcgaccaaagggaccaaggtgaaatcgaaaacgatgagntagctaccattctgttctacacgtccttcccgactntctac

SEQ ID NO: 169607 - DNA, 499 bp, Homo sapiens
  misc_feature: GYAE6OF02H3JF4.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccggggtcctgaccgattcagtgcagcggtctggacagattcactctcaccatcaacagctgcaggctgaggatgtggcgtatttatactgtcagcagtattataatactcctccgacgttccggaccgaagggaccaagggtgaaactcaaacgaactgtgctgcaccatctgtcttcattcctcccgctatctacg

SEQ ID NO: 169608 - DNA, 508 bp, Homo sapiens
  misc_feature: GYAE6OF02IOLJD.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatctaccgggagtccggggtccctgaccgattcagtggcagcggtctggacagatttcactctcacctatcaacagcctgcaggctgaggatggtgcgtatttatactgtcagctaagttacttataactcctccgtcgacgttcggacctaagggaccaagggtgaaactcaaaacgactgtgctgcaccatctgtcttcacttcctcccgctatctacg

SEQ ID NO: 169609 - DNA, 501 bp, Homo sapiens
  misc_feature: GYAE6OF02FKMR3.37.11.A11.1.454.CMB.1.raw
  modified_base (475)..(475): a, c, t, g, unknown or other
  misc_feature (475)..(475): n is a, c, g, or t
  modified_base (498)..(498): a, c, t, g, unknown or other
  misc_feature (498)..(498): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcctctacccgggaatccggggtccctgaacgattcagtggcggcgggtctgggacagtattcactctcaccatcagcagcctgcgggctgaagatgtggtcggtttattactgtcagcagtattatgttactcctcactgtttcgccgagggaccaagcgtggagagtcgcacgactgtggctgcaccntctgtcttcatccttcccgcctntcg

SEQ ID NO: 169610 - DNA, 502 bp, Homo sapiens
  misc_feature: GYAE6OF02GMW2D.37.11.A11.1.454.CMB.1.raw
  modified_base (282)..(282): a, c, t, g, unknown or other
  misc_feature (282)..(282): n is a, c, g, or t
  modified_base (376)..(376): a, c, t, g, unknown or other
  misc_feature (376)..(376): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcatttacngggcatctacccgggagtccggggtccctgaccgattcagtggcagcgggtctggacagattcactctcacatcaacagcctgcaggctgaggntgtggcgtatttatactgtcagcagtattataatactcctcgacgttcgacaagggaccaaggtgaaatacaaacgtactgtgctgaccaaccatctgtcttacacttccttcccgcctatctacg

SEQ ID NO: 169611 - DNA, 542 bp, Homo sapiens
  misc_feature: GYAE6OF02G4O13.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagcctaccaaacaataagaacttacttagcttggtatcagcaagaaaccagggcagcctacctaaactgctcatttacgtgggcatccgtacccggggaggtcccggggtccctggaccgtattcgagtggcaggtcgggtcgtggacagtatttcactctcaccatcaacagcctgcaggctgaggatgtggacgtatttactactgtcagctagttattaataactacctcctccgacgttccggaccgaagggaccaaggtagaaactacgaaacgacgttgcgctgccaccatctgttcttctacttccttcccgacctatctaacg

SEQ ID NO: 169612 - DNA, 624 bp, Homo sapiens
  misc_feature: GYAE6OF02IYBBL.37.11.A11.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
  modified_base (566)..(566): a, c, t, g, unknown or other
  misc_feature (566)..(566): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctccaanaataagaactacttagcttggtatcagcagaaccagggcagcctactaaactgctcatttacnggcatcctaccgggagtcccgggtcctgaccgtattcagtcggcaggcggtctagggacaggtactttcgactcgtcaacctatccaaacncggaccctgccagggccttaggacggtatcggtcggtacgtaattttacgttactggtacctagtctaagttatttaactaaacgttacctccgttaccggaacgtttccgggaccgtaaacggggacctaaacggggttagaaaacgttacaaaaccggtacgttagggtcggtataccggacctaacccgngtttaccgtcggtttacctttaccgactttcccgttaccccggcctaagttccctaag

SEQ ID NO: 169613 - DNA, 521 bp, Homo sapiens
  misc_feature: GYAE6OF02HFHI1.37.11.A11.1.454.CMB.1.raw
tcagtagtgtagatcacgaccggtgctcgatttagctacgactgcgaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccaggccagactgttttatacagcctccaacaataagaactacttagcttggtatcagcagtaaaccagggctagccctcctaaactgctcatttactgggcagtcgtacccgggagtccggggtcctgaccgattcagtggcaggcgggtctgggacagatttcactctcaccatcaacagcctgcaggctggaggatggtggcgtaattttatactgtcagcagtattataatctcctcgacgttcgccaagggaccaagggtcgaaatccaaaacgtacgtagtaggctgccactatctgtcttcactccttcccggctactctacg

SEQ ID NO: 169614 - DNA, 539 bp, Homo sapiens
  misc_feature: GYAE6OF02HUS3Z.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaaacaaataaagaactacttagcttggtatcagcaagaaaaccagggcagcctactaaactgctctatttactgggcatccgtacccgggacgtcccgggtccctgaccgtattcgagtggcaggccgggtcgtgggacagtactttcacttctcaccatacaacagcctgcaggctgagatgtggctatttatactgtacagctagttattaataatactcctcgacgttcggaccgaagggaccaaggtacgaaatacgaaaacgtactaggtgactgacaccatctcgtcttactacttcccttacccgctatctacg

SEQ ID NO: 169615 - DNA, 497 bp, Homo sapiens
  misc_feature: GYAE6OF02J2B8Z.37.11.A11.1.454.CMB.1.raw
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
  modified_base (479)..(479): a, c, t, g, unknown or other
  misc_feature (479)..(479): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgtatttattactgtcagctagtattanaatactcctcgagttcgcaaggaccaaggttgaaactcaaacgtangtgctgcacatctgtcttcntccttcccgctatctacg

SEQ ID NO: 169616 - DNA, 499 bp, Homo sapiens
  misc_feature: GYAE6OF02IUDXC.37.11.A11.1.454.CMB.1.raw
  modified_base (461)..(461): a, c, t, g, unknown or other
  misc_feature (461)..(461): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctggacagattcactctcacatcaacagcctgcaggctgaggatgtggcgtatttatactgtcagcagtattataatactccgtcgacgttcggaccgaagggaccaaggtcgaaatcaaacgactgngctgcaccatctcgtcttcattcctcccgctatctacg

SEQ ID NO: 169617 - DNA, 492 bp, Homo sapiens
  misc_feature: GYAE6OF02JD2FP.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatctacccgggagtccgggtcctgaccgattcagtggcagcgggtctggacagatttcactctcacatcaacagcctgcaggctgaggatggtggcgtatttatactgtcagcagttattataatactcctcgacgttcggccaaggaccaaggtgaaatcaaacgactgtgctgcacatctgtcttcatccttccgctatctag

SEQ ID NO: 169618 - DNA, 518 bp, Homo sapiens
  misc_feature: GYAE6OF02HLIDK.37.11.A11.1.454.CMB.1.raw
  modified_base (208)..(208): a, c, t, g, unknown or other
  misc_feature (208)..(208): n is a, c, g, or t
  modified_base (282)..(282): a, c, t, g, unknown or other
  misc_feature (282)..(282): n is a, c, g, or t
  modified_base (318)..(318): a, c, t, g, unknown or other
  misc_feature (318)..(318): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctctaaactgctcatttacngggcatcgtacccgggagtcccggggtcctgaccgnttcagtggcaggcgggtctgggacagtatttccactctcacatcaacacgcctgcaggctagaggatgtggctatttatactgtcagctagttattataactactcctacgacgttcgacgtaagggacctaagggtagaaactacaaacgtactgacgctacgcaccagtctgtcttcacttccttcccgctatctacg

SEQ ID NO: 169619 - DNA, 500 bp, Homo sapiens
  misc_feature: GYAE6OF02GC0AV.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagccctgcaggctgaggatggtggcgattttatacgtgtcagcagtattataatactcctccgacgttcggcaagggaccaaggtgaaatcaaacgatgtgctgcacatctagtcttcattcctaccgctatctacg

SEQ ID NO: 169620 - DNA, 509 bp, Homo sapiens
  misc_feature: GYAE6OF02IQVRK.37.11.A11.1.454.CMB.1.raw
  modified_base (486)..(486): a, c, t, g, unknown or other
  misc_feature (486)..(486): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcaggcgggtctgggacagtattcactctcaccatcaacagcctgcaggctgaggatgtggcgtatttattactgtcagctagttattataactacctcctccgtacgttcggaccaagggaccaagggtcgaaatcgaaaacgactgtgctgcaccatcngtcttcattcctccgctatctag

SEQ ID NO: 169621 - DNA, 506 bp, Homo sapiens
  misc_feature: GYAE6OF02HM6VZ.37.11.A11.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (411)..(411): a, c, t, g, unknown or other
  misc_feature (411)..(411): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctacctaaactgctcatttacngggcatcgtacccgggagtccgggtcctgaccgattcagtggcagcgggtctggacagattcactctcaccatacaacagcctgcaggctaggagatgtgcgtatttatactgtcagctagtattanaatactcctcgacgttacggacaagggacctaaggtacgaaatacaaaacgactgagctagcacatctgtcttacactcctcccgactatctacg

SEQ ID NO: 169622 - DNA, 502 bp, Homo sapiens
  misc_feature: GYAE6OF02HR6MQ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccgggtccctgaccgattcagtggcagcgggtctgggacagatttcactctcaccatcaacagcctgcaggctgaggatgtggcgtatttatactgtcagctagtattataatactcctcgacgttcggaccaagggaccaaggtgaaatcaaaacgactgtgctgcaccatctgtcttcactccttcccgactatctacg

SEQ ID NO: 169623 - DNA, 498 bp, Homo sapiens
  misc_feature: GYAE6OF02JDWM6.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctgggacagatttcactctcaccatcaacagcctgcaggctgaggatgtggcgtatttattactgtcagcagtattataatactcctccgacgttcgccaagggaccaaggtgaaatcaaacgactgtgctgcaccatctgtcttcattcctcccgctatctacg

SEQ ID NO: 169624 - DNA, 514 bp, Homo sapiens
  misc_feature: GYAE6OF02FHL1I.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaatagaactacttagcttggtatcagcagaaaccagggcagcctcctaaactgctcattactggcatctaccgggatccggggtcctgaccgattcagtggcagcgggtctgggacagtatttcactctcaccatcaacagcctgcaggctgaggatgtggctatttattactgtcagcagttattataatactcctcgtacgttcggaccaagggaccaagggtgaaactacaaacgaactgtcggctggaccaccattcctgtcttacacttcccgttcccgcctatcctacg

SEQ ID NO: 169625 - DNA, 513 bp, Homo sapiens
  misc_feature: GYAE6OF02GUUG3.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctggaccgattcagtggcaggcgggtctggacagattcactctcacatcaacagcctgcaggctgaggatggtggcgtatttatactgtcagcagttattataatactcctcgtacgttcggaccaaggaccaaggtacgaaatcaaaagactagtcggctaggcaaccatcgtgttcttcacttcctcccgacctatctacg

SEQ ID NO: 169626 - DNA, 531 bp, Homo sapiens
  misc_feature: GYAE6OF02FM0I1.37.11.A11.1.454.CMB.1.raw
  modified_base (362)..(362): a, c, t, g, unknown or other
  misc_feature (362)..(362): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcattactgggcatctacccgggagtcccggggtcctgaccgattcagtggcagcgggtctgggacagtattcactctcacatcaacngcctgcaggctgaggatggtggcgtatttatacgtgtcagcagttattataatactcctccgtacgttcggaccaaagggaccaagggtagaaactcaaaacgaactggtaggctggaccacctatccgttgttccttaccagttccctttcccggccctattcctacg

SEQ ID NO: 169627 - DNA, 503 bp, Homo sapiens
  misc_feature: GYAE6OF02HDAXC.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctgggacagattcactctcaccatcaacagcctgcaggctgaggatggtggcgtatttattactgtcagcagtattataatactcctcgacgttcggaccaagggaccaaggtacgaaatcgaaacgactggtgctgcacatctgtcttcatccttcccgctactctacg

SEQ ID NO: 169628 - DNA, 631 bp, Homo sapiens
  misc_feature: GYAE6OF02F8IB6.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccgagggcagcctacctaaactgctcatttactgggcatcgtacccgggagtccgggtcctgaccgattcagtggcgagcgggtctgggacagtattcactctcacatcaacacgcctgcgagctgagatggtggcgtaatttattacgtgtacaggtctagttaatttacgtaaacttaccttacccgttaccgtaaccggttaccgggacccgtaaaacgggggtacccgaaaggggtttacggaaaaacttaccggaaaaaccgtaacgttacggtacgggtacctacggtaacccgtaacccgtaagttcccgtttacgttcctttacgttaacctttcccgttaaccccggtacccttacgttaccttaaccgg

SEQ ID NO: 169629 - DNA, 602 bp, Homo sapiens
  misc_feature: GYAE6OF02HHWEM.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaaacaataagaactacttagcttggtatcagcagaaaccagggcagcctcctaaaactgcctactatttacgtggacactccgtaccgggacggtcccgggtcctcgaaccgtattcgaggtcggacgaggtccgggtcgtacgggaactagtactttacacttctacaacctatacaaacacgccctgccgaggtctggaggtatggtggacgttaatttaattactgtacagactaagttattaataatcctccgtacgtacgttaccggaccgaaacggaccgtaaggtacgaaacgtaacgaaaacgtaacgtggtacggctacggaacctacctacttcgttcgttacttactacgttcccttaccccgactactctaacg

SEQ ID NO: 169630 - DNA, 560 bp, Homo sapiens
  misc_feature: GYAE6OF02FZ897.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctaccaacaataagactaaaacttgacgtttagatcagcaagaaaccagggcagcctacctaaactgctctatttactgggcatccgtaccccggggagtcccggggtccctgaccgattcagtggcagcgggtctgggacagatttcactctcaaccatacaaacgactccctgacgaggctaggaggtagtcggtggcgtatttattactgtcagctattattaataacgtcctcctcgtacggttcgaccgaacgggaccgaagggtagaaactacgaaaaccgtagtgtggactacggaccactaactcgttcgttacttcacttcccttcccactactctaacg

SEQ ID NO: 169631 - DNA, 509 bp, Homo sapiens
  misc_feature: GYAE6OF02IT2R7.37.11.A11.1.454.CMB.1.raw
  modified_base (362)..(362): a, c, t, g, unknown or other
  misc_feature (362)..(362): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctctaaactgctcatttactgggcatctacccgggagtccgggtccctgaccgattcagtggcaggcgggtctgggacagtattcactctcacatcaacncgcctgcaggctgaggatgtggctagtttatactgtcagctagttatataattcctccgtccgacgttccggaccgaagggaccaaggtacgaaatcaaacgactggtgctgcacatctgtcttacgactcctccgactagtctacg

SEQ ID NO: 169632 - DNA, 529 bp, Homo sapiens
  misc_feature: GYAE6OF02HF0SW.37.11.A11.1.454.CMB.1.raw
  modified_base (366)..(366): a, c, t, g, unknown or other
  misc_feature (366)..(366): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagcctccaacaataagaactacttagcttggtatcagcagaaaccagggcagcctcctaaactgctcatttactgggcactcgtacccgggagtccggggtccctgaccgattcagtgcagcgggtctggacagatttcactctcaccatccaacngcctgcaggctgaggatggtggcgtatttattactgtcagctagtattataatacctcctcgtacgttcggaccgaagggaccgaaggtacgaaatacgaaacgtacgtgtaggctcgcacctatcctgttcttactacttcccttcccgacctactctaacg

SEQ ID NO: 169633 - DNA, 534 bp, Homo sapiens
  misc_feature: GYAE6OF02IEVBX.37.11.A11.1.454.CMB.1.raw
  modified_base (368)..(368): a, c, t, g, unknown or other
  misc_feature (368)..(368): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctcatttactgggcatcgtacccgggagtccggggtcctgaccgattcagtggcaggcgggtctggacagtattcactctcaaccatccaacncgcctgcaggctggaggatggtggcgtatttactactgtcagtctaagttattaataactcctcctccgtacgttccggaccgaaagggaccaaggtacgaaatacgaaaacgtacgtgtaggctagcctaccatcctgtcttcactccttacccgctactctacg

SEQ ID NO: 169634 - DNA, 630 bp, Homo sapiens
  misc_feature: GYAE6OF02ITAX9.37.11.A11.1.454.CMB.1.raw
  modified_base (301)..(301): a, c, t, g, unknown or other
  misc_feature (301)..(301): n is a, c, g, or t
tcagtagtgtagatcacgaccggtgctcgatttagctacgactgcaggggcgagcaagatggtgttgcagacccaggtcttcatttctctgttgctctggatctctggtgcctacgggacaccgtgatgacccagtctccagactccctggctgtgtctctgggcgagagggcctccatcaactgcaagtccagccagactgttttatacagctaccaacaataagaacttacttagcttaggtatcagcaagaaaccagggaccacgacctacctaaactcgtacttacgattttaaccngggtacaacgtccgtaacccgggacggtcccgggtccctgaccgtattcgagtcggcgacggcggtctagggactagtactttacacgtactacactacttcaaaccgcggtcctagacgtacggctacggaaggtagttacgggtgacgttatttacttacgtgtacagtactaaggttattaataactacctcccgtacggtacgttaccggtacgaacgggaaccgtaaggtacgtaaacttaccgaaaacgtagtcgtacggtactacgctaaccgatccgttagttccttacgtacgttcccgtccccgtactaccttgtaacg

SEQ ID NO: 169635 - DNA, 492 bp, Homo sapiens
  misc_feature: GYAE6OF02HDBEI.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctggacagatttcactctcaccatcaacagcctgcaggctgaggatgtggcgatttatactgtcagcagtattataatactctcgacgttcggccaagggaccaaggtgaaatcaaacgactgtgctgcaccatctgtcttcatctcccgcatctacg

SEQ ID NO: 169636 - DNA, 587 bp, Homo sapiens
  misc_feature: GYAE6OF02HLXW1.37.11.A11.1.454.CMB.1.raw
  modified_base (285)..(285): a, c, t, g, unknown or other
  misc_feature (285)..(285): n is a, c, g, or t
  modified_base (342)..(342): a, c, t, g, unknown or other
  misc_feature (342)..(342): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaaacaataagaactacttagcttggtatcagcagaaaccagggcagcctacctaaactgctcatttacngggcatccgtacccgggaggtcccgggtccctgaccgtattcagtggcaggcgggtntggacagtatttcactctacaccataccaacacgtcctgcagggctggaggattggaggtctaattttacttacgtgtcagtactagttaattaataacttacctccgttaccgtaccggttccgaccgtaacgggacctaagggtagaaaacttacgaaaacggtaactggtacgtactacggaacctaccgtattccgtagttacctttcactttcccgttacccccggactacgttctaacg

SEQ ID NO: 169637 - DNA, 495 bp, Homo sapiens
  misc_feature: GYAE6OF02GN4SD.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaaccagggcagcctcctaaactgctcatttactgggcatctacccgggagtccggggtccctgaccgattcagtggcagcggtctgggacagatttcactctcaccatcaaacagcctgcaggctgaggatgtggcatttatactgtcagcagtattataatactcctcgagttcgccaagggaccaaggtggaaatcaaacgaactgtgctgcaccatctgtctcatcttcccgctatctacg

SEQ ID NO: 169638 - DNA, 620 bp, Homo sapiens
  misc_feature: GYAE6OF02HHS26.37.11.A11.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
  modified_base (332)..(332): a, c, t, g, unknown or other
  misc_feature (332)..(332): n is a, c, g, or t
tcagtagtgtagatcacgaccggtgctcgatttagctacgactgcaggggtcgagcaagactggtgtgcagacccaggtcttcatttctctggttcgctctggatctcgtggtcgcctacggggacaccgtgatgacccagtcctccagactccctggctgtagtctcctgggcagagggccctccatcaactgcaagtccagccagactgttttanacagcctccaacaagtaagaactactagcttggatcagcagaaaccngggcagcctactaaactgactcactttacgcgggcatccgtaccgggagtcccgggtcctggacccgnttcagtggctaggcgggtgtcgggaccagtactttcgactctcacctatacaacacgtcctggaccaggcttaggacgtattcggtaggtactaatttactactagtcaaggtcctaagttacttaagtaaattccttacccgtacgtaccgtttacggaccgtaaagggaacctaaagggtagtaaacttaacgaaaacgtaccttggtggtaccgtaggccctaaccgtacgttacgtcggttaaccttccgaacttccgttaccccggtactagttaccgtaacg

SEQ ID NO: 169639 - DNA, 502 bp, Homo sapiens
  misc_feature: GYAE6OF02HG5H8.37.11.A11.1.454.CMB.1.raw
  modified_base (369)..(369): a, c, t, g, unknown or other
  misc_feature (369)..(369): n is a, c, g, or t
  modified_base (470)..(470): a, c, t, g, unknown or other
  misc_feature (470)..(470): n is a, c, g, or t
  modified_base (482)..(482): a, c, t, g, unknown or other
  misc_feature (482)..(482): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaaacaaataagaactacttagcttggtatcagcaagaaaccagggcagcctacctaaactgctcatttactgggcatcgtacccgggagtccggggtccctgaccgattcagtggcaggcgggtctgggacagatttcactctcacatcaacngcctgcaggctgaggatggtggctatttatactgtacagctagtattataatactcctcgtacgttcgaccaagggaccaaggtgaaatcgaaacgactgngctgcacatctntctcactcctccgctatcta

SEQ ID NO: 169640 - DNA, 498 bp, Homo sapiens
  misc_feature: GYAE6OF02HHEEI.37.11.A11.1.454.CMB.1.raw
  modified_base (208)..(208): a, c, t, g, unknown or other
  misc_feature (208)..(208): n is a, c, g, or t
  modified_base (363)..(363): a, c, t, g, unknown or other
  misc_feature (363)..(363): n is a, c, g, or t
  modified_base (462)..(462): a, c, t, g, unknown or other
  misc_feature (462)..(462): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccggggtccctgaccgattcagtggcagcgggtctgggacagattcactctcaccatcaacngcctgcaggctgaggatgtggctatttatactgtcagctagtattataatctcctcgacgttcggaccaagggaccgaaggtcgaaatcaaacgactgngctgcaccatctgtctcatccttcccgctatctacg

SEQ ID NO: 169641 - DNA, 600 bp, Homo sapiens
  misc_feature: GYAE6OF02I98TX.37.11.A11.1.454.CMB.1.raw
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
tcagtagtgtagatcacgaccggtgctcgatttagctacgactgcaggggcgagcaagatggtgttgcagacccaggtcttcatttctctgttgctctggatctctggtgcctacggggacaccgtgatgacccagtctccagacttccctggctgtgtctctgggcgagagggcctccatcgaactgcaagtccagccagactgtttanacagctccaanaataagactacttagcttggtatcagcagaaccaggcacgcctactaaactgctcatttacgnggacatccgtaccgggaggtccgggtacctggaccgtattcagtggcaggtcggtctgggactaggtactttcacgttctacacgataccaacacgtcctgacacggtctaggaggtacgtcggtaggtaccgttaatttacgtacgtacgtactaggtactagtaagtttaactaacgttacctaccggttccggtaacggtttaccggaaccgtaacgggtactaaggtacgtaactacgaaacgtacgttgaggtactagtccaactgtacctcgttacttacgaactttcccgtaccctacgtattctaacg

SEQ ID NO: 169642 - DNA, 708 bp, Homo sapiens
  misc_feature: GYAE6OF02J3W6F.37.11.A11.1.454.CMB.1.raw
  modified_base (137)..(137): a, c, t, g, unknown or other
  misc_feature (137)..(137): n is a, c, g, or t
  modified_base (609)..(609): a, c, t, g, unknown or other
  misc_feature (609)..(609): n is a, c, g, or t
tcagtagtgtagatcacgaccggtgctcgatttagctacgactgcaggggcagcaagatggtgttgcagacccaggtcttcatttctctgttgctctggatctcgtggtcgccgtacgggacaccgtgactcgaccngtctcacgctcctggctgtgtcgtcgtggcgagacggcctcatacaacgtgacgtaacgtccagccgtagtactttagtttacacacgtacctaaccaaactaataacgtaacttacgttacgccgtttagacgacgacgacgaaacggaaccgcggacctacgtaccctacgtaactcgtacttacgttacgtttaccggcggaccgtaccggttacccggtacccggggtacggtaccccgggttacacggtaaccgttcgttacggacgggtccgacggtacggtcggtacgacggactcgtacttccacctcgaccactacgacgtaccgcgttccgagtcgtacggttacgtggtaacgttacgtcgggttactttaaccgtagtttaactcgttacgacgtacgttattacgttaacttccgtcgttacctcgatttacggtagtacgacggttaagcgacgttancggactacggtccaacctcggtacgtcgtcggaaaccttcccgaacgtttactcggtttaaccccgttgttaccccgtccttacccggtaccctttacc

SEQ ID NO: 169643 - DNA, 508 bp, Homo sapiens
  misc_feature: GYAE6OF02F8AKJ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcattactgggcatctacccgggagtccggggtcctgaccgattcagtggcagcgggtctgggacagattcactctcaccatcaacagcctgcaggctgagagtgtggcgatttattactgtcagcagtattataatactcctcgacgttcgctaacggacgaaggtcgaaatacgaaacgacgtagtcgactgccacactcgtgtccttacacttccttcccgtctactctacg

SEQ ID NO: 169644 - DNA, 572 bp, Homo sapiens
  misc_feature: GYAE6OF02I6TBA.37.11.A11.1.454.CMB.1.raw
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctaccaacaataagaactacttagcttggtatcagcaagaaaccagggcagacctcctaaaactgctcatttacngggcatccgtacccggagtcccggggtcctgaccgattcgagtggcagcgggtctgggacagtattcactctcaccatcaacagcctgcacggtctggacggatggtggcgtagttttaactacttgtaccagtccaagttattaactaagttaacctcccgtacgtacgttccgaccgaaacgggtacccgtaaggtacgtaaactaccgaaaccgtaagtcgtaggactcggaacaccgtaatcgttacgtcttaccacgttaccttcccgactacctagtacg

SEQ ID NO: 169645 - DNA, 534 bp, Homo sapiens
  misc_feature: GYAE6OF02FQNE5.37.11.A11.1.454.CMB.1.raw
  modified_base (529)..(529): a, c, t, g, unknown or other
  misc_feature (529)..(529): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcatttactgggcatctacccgggagtccggggtccctgaccgattcagtggcagcgggtctgggacagatttcgactctcaccatcaacagcctgcaggctgaggatggttgcgtatttattactgtcagcagttattataatctcctccgacgtttcggaccgtaagggaccaagggtacgaaactacgaaaacgtaacgtgtaggctggccaccctatcgttcgttcttacgacttcccgttacccgctactntaacg

SEQ ID NO: 169646 - DNA, 509 bp, Homo sapiens
  misc_feature: GYAE6OF02GC1HK.37.11.A11.1.454.CMB.1.raw
  modified_base (208)..(208): a, c, t, g, unknown or other
  misc_feature (208)..(208): n is a, c, g, or t
  modified_base (479)..(479): a, c, t, g, unknown or other
  misc_feature (479)..(479): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccggggtcctgaccgattcagtgcagcgggtctggacagtattcactctcaccatcaacagcctgacaggctgaggatggtgcgtatttattactgcagacagttattataatacctcctcgtacgttcggaccaagggaccaagggtagaaatacaaaacgactggagctgcaaccntctgtactctacttcctcccgctatctacg

SEQ ID NO: 169647 - DNA, 520 bp, Homo sapiens
  misc_feature: GYAE6OF02F5I1G.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtcctgaccgattcagtggcagcgggtctggacagatttcactctcaccatcaacagcctgcaggctgagatgtggcgtatttattactgtcagcagttattataatactcctccgacgttcggaccgtaagggaccaagggtagaaactacgaaacgtaactggtacgactcggcaaccagtcctagtcttcacttccttccgcctatctacg

SEQ ID NO: 169648 - DNA, 563 bp, Homo sapiens
  misc_feature: GYAE6OF02HTCGF.37.11.A11.1.454.CMB.1.raw
  modified_base (290)..(290): a, c, t, g, unknown or other
  misc_feature (290)..(290): n is a, c, g, or t
  modified_base (403)..(403): a, c, t, g, unknown or other
  misc_feature (403)..(403): n is a, c, g, or t
tcagtagtgtagatcacgaccggtgctcgatttagctacgactgcaggggcaggcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagcctaccaacaataagaactacttagcttggtatcagcagaaaccagggcagcctacctaaactgactcaatttacngggctagtccgtacccggggagtcccggggtccctggaccgtattcgagtggcaggtcggtctgggacagtatttcactcacaccatacaacacgctgcaggctgaggatggnggctatttatacgtgtcagctagtattataatctcctacgacgttacgacgtaaggacctaaggtagaaactcgaaaacgtacgtggtacggctacggcctaacctagtcgttacgttcttaccgtacgttcccgttacccgaccttactccgttaaccg

SEQ ID NO: 169649 - DNA, 673 bp, Homo sapiens
  misc_feature: GYAE6OF02IF7S7.37.11.A11.1.454.CMB.1.raw
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
  modified_base (388)..(388): a, c, t, g, unknown or other
  misc_feature (388)..(388): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagagggcctccatcaactgcaagtccagccagctgtttananagctcaaacaataagaactacttagcttggatcagcaagaaaccnggcagcctactaaactgctanactttacgnggacagtccgtaaccgggagtcccgggtccaggaccgtatcgacgtggccaggccgggtcgtagggaccagtactttccaacttctcgaaccataccgaaacncgtcccgtagccgaaggtcgtagggaaaggtacgtcggtaggtaccggttaattttaacgttaccgtaggttaccaacggttactaaagggtttaatttaacgttaaaacttacctaccccggtaccgttaacgggtttccggacccggtaaagggtacccgtaaagggtagaaaaccgtacgaaaacgtactaggtcggcgttaccggaactaccgtaacttccggttacgttaccttacgtaacccgttcccgttaaccccggaccttacgttaccgttaacg

SEQ ID NO: 169650 - DNA, 586 bp, Homo sapiens
  misc_feature: GYAE6OF02HDY0L.37.11.A11.1.454.CMB.1.raw
  modified_base (328)..(328): a, c, t, g, unknown or other
  misc_feature (328)..(328): n is a, c, g, or t
  modified_base (575)..(575): a, c, t, g, unknown or other
  misc_feature (575)..(575): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaacttacttagcttggtactacagacaagaaaccagggacacgcctacctaaactgctcatttactgggcatctaccggagtccgggtacctcgaccgatcngtggcaggcggtcgtcggacgagattcgacttctccacgtactccaactagaccgtacgcacggcgtagacggtatggtggcgtagtttactacttagtctagtactagtattaatatacttacctaccgtacgttaccggaccgtaaggtaccgtaacggttacgggaaacgtaccgtaaacgaacgtggtaggacttacggactaccggataccgtgttccgttacacgttcctacccgtacctnttacctaccgg

SEQ ID NO: 169651 - DNA, 497 bp, Homo sapiens
  misc_feature: GYAE6OF02HM4R9.37.11.A11.1.454.CMB.1.raw
  modified_base (461)..(461): a, c, t, g, unknown or other
  misc_feature (461)..(461): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgatttatactgtcagcagtattataatactcctcgacgttcggccaagggaccaaggtgaaatcaaacgaactgnggctgcaccatctgtcttcatcttcccgctatctag

SEQ ID NO: 169652 - DNA, 552 bp, Homo sapiens
  misc_feature: GYAE6OF02IJUUO.37.11.A11.1.454.CMB.1.raw
  modified_base (209)..(209): a, c, t, g, unknown or other
  misc_feature (209)..(209): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (371)..(371): a, c, t, g, unknown or other
  misc_feature (371)..(371): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctccaaacaataagaactacttagcttggtatcagcagaaaccagggcagcctacctaaactgctcatttactgggcatcgtacccgggagtccggggtccctgaccgnttaacgngtggcagcgggtctggacagtatttcactctcaccatcaacngcctgcaggctggaggatgtgcgtatttatactgtcagtctagttattataatcctcctccgacgttcggaccgaagggacctaaggtacgaaatacgaaacgtactaggtacggctcggaccaaccgtattccgttcgttccttaccacgtttcccgttaccccgtcttactccgtaacg

SEQ ID NO: 169653 - DNA, 537 bp, Homo sapiens
  misc_feature: GYAE6OF02IYAEY.37.11.A11.1.454.CMB.1.raw
  modified_base (347)..(347): a, c, t, g, unknown or other
  misc_feature (347)..(347): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaccagggcagcctctaaactgctcattactggcatcgtacccgggagtccgggtccctgaccgattcagtggcagcggtctggacagatttcactcncacatcaacagcctgcagctgaggatgtggcgtatttattactgtcagtctagttattataacttacctcctaccggtacgttccggacccgaagggtacccaagggtacggaaactacgaaacgaacgtcgtagggactggacctaaccatccgtgtacttccacgttccttaccccgctacttctacg

SEQ ID NO: 169654 - DNA, 547 bp, Homo sapiens
  misc_feature: GYAE6OF02IQ7FK.37.11.A11.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccagggcagcctacctaaactgctcatttacngggcactcgtaccgggagtcccgggtccctgaccgattcagtggcagcgggtcgtggacagactttcactctcacatacaacacgcctgcgaggctgaggatggtggtcgtatttatactgtcagtctagtattaataatactcctacgtacgttaccggaccgaaacgggaccgaaggtagaaactacgaaacgtaacgtaggtgtacgtagccacctatcttcgttccttctacttcccgttccccgactactacttacg

SEQ ID NO: 169655 - DNA, 606 bp, Homo sapiens
  misc_feature: GYAE6OF02GJE6L.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactgctcatttactgggacatcctacccggggagtcccggggtccctggaccgattcagtggcagcgggtcgtggacagtatttcactctcaccatacaacacgcctgcaggctggaggatggtggctatttatactgtacagctaagttattaataacgttacctcccgtaccgtaccggtttaccggacctaaacgggggacctaaaggggtacgtaaaactaccgaaaacgtaacgtggtacgggtactacgggcccaacctagttaccttcggtttacctttaccctaccgtttcccgttaccccccggtaccttattcccgttaaccgg

SEQ ID NO: 169656 - DNA, 524 bp, Homo sapiens
  misc_feature: GYAE6OF02JGODL.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattccagtcggcaggcgggtctgggacagatttcactctcaccatcaacagcctgcaggctgagatgtgcgtatttatactgtcagctagtattataatacctctacccgtagttccggaccgaaagggaccaaggtacggaaatacgaaacgtaactgtaggctaggcaccatcgtgttcttcgacttccttcccgctactctacg

SEQ ID NO: 169657 - DNA, 549 bp, Homo sapiens
  misc_feature: GYAE6OF02HK917.37.11.A11.1.454.CMB.1.raw
  modified_base (208)..(208): a, c, t, g, unknown or other
  misc_feature (208)..(208): n is a, c, g, or t
  modified_base (282)..(282): a, c, t, g, unknown or other
  misc_feature (282)..(282): n is a, c, g, or t
  modified_base (387)..(387): a, c, t, g, unknown or other
  misc_feature (387)..(387): n is a, c, g, or t
  modified_base (417)..(417): a, c, t, g, unknown or other
  misc_feature (417)..(417): n is a, c, g, or t
  modified_base (502)..(502): a, c, t, g, unknown or other
  misc_feature (502)..(502): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctctaaactgctcatttacngggcatccgtacccggggagtccggggtccctggaccgattcagtggcaggcgggtctgggacagtacttcactctcaccatcaacagcctgcaggctgagatgnggctatttatactgtcagtctagttattanaaactctccgtacgaccgttcggaccgtaagggaccaaggtagaaactaccgaaaacgtactgggtacgcttacggctaacccgnttacctgttacctttacacttcccttccccggacctagttcctaacg

SEQ ID NO: 169658 - DNA, 505 bp, Homo sapiens
  misc_feature: GYAE6OF02HKWN0.37.11.A11.1.454.CMB.1.raw
  modified_base (208)..(208): a, c, t, g, unknown or other
  misc_feature (208)..(208): n is a, c, g, or t
  modified_base (365)..(365): a, c, t, g, unknown or other
  misc_feature (365)..(365): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatcgtacccgggagtccggggtccctgaccgattcagtggcaggcggtctgggacagatttcactctcaccatcaacngcctgcaggctgaggatggtggcgtatttatactgtcagctagtattataactactcctcgtacgttcggaccgaagggaccaaggtgaaatacaaacgactgtgctgcacctatctgtctcactcctccgctatctacg

SEQ ID NO: 169659 - DNA, 537 bp, Homo sapiens
  misc_feature: GYAE6OF02I2AE0.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccaggcagcctcctaaactgctcatttactgggcatcgtacccgggagtccggggtccctggaccgattcagtggcagcgggtctgggacaggtatttcactctcaccatcaacagcctgcaggctgagatgtggctatttatctgtcagcagttattataatactcctcgtacgttccgaccgaagggaccaaggtcgaaatacgaaacgtaactggtacgactcgcctaacctagtaccgttgtacctttcgaccttccgttccccgcctacttccgttaacg

SEQ ID NO: 169660 - DNA, 513 bp, Homo sapiens
  misc_feature: GYAE6OF02F6MYB.37.11.A11.1.454.CMB.1.raw
  modified_base (509)..(509): a, c, t, g, unknown or other
  misc_feature (509)..(509): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctggaggatggtggcgtattttatactgtcagcagttattataatactcctccgtacgttcggaccaagggaccaagggtagaaatcaaaacgactggtgactgcaccatcctgtcttcactccttcccgctactntacg

SEQ ID NO: 169661 - DNA, 540 bp, Homo sapiens
  misc_feature: GYAE6OF02GB4WY.37.11.A11.1.454.CMB.1.raw
  modified_base (382)..(382): a, c, t, g, unknown or other
  misc_feature (382)..(382): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggacggtccggggtccctgaccgattcagtggcgaggcggtctggacagattcactctacaccatcaacagcctgcaggctggagngtggtggacgtattttattactgtacgagtctagttaattataactactcctccgtacgttcggaccgaagggaccgaaggtagaaactacgaaacgtacgtggtaggctgaccacctacgtctgttcttactacttccttccccgcttactctaacg

SEQ ID NO: 169662 - DNA, 521 bp, Homo sapiens
  misc_feature: GYAE6OF02HCT6L.37.11.A11.1.454.CMB.1.raw
  modified_base (382)..(382): a, c, t, g, unknown or other
  misc_feature (382)..(382): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtcccggggtccctgaccgattcagtggcaggcgggtctgggacagattcactctcaccatcaacagcctgcgaggcctgagntggtggcgtatttatactgtcagctagtattataatactcctccgtacgttcggaccaagggaccaagggtgaaaatacaaaacgtactggtcggactgaccaccagtctgttctctactccttacccgctactctacg

SEQ ID NO: 169663 - DNA, 538 bp, Homo sapiens
  misc_feature: GYAE6OF02IG63M.37.11.A11.1.454.CMB.1.raw
  modified_base (207)..(207): a, c, t, g, unknown or other
  misc_feature (207)..(207): n is a, c, g, or t
  modified_base (281)..(281): a, c, t, g, unknown or other
  misc_feature (281)..(281): n is a, c, g, or t
  modified_base (374)..(374): a, c, t, g, unknown or other
  misc_feature (374)..(374): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctcaacaataagaactacttagcttggtatcagcagaaaccagggcagcctactaaactgctcatttacnggcatctaccgggagtccggtcctgaccgattcagtggcagcggtctggacagacttcactctcaccatacaacagcctgcaggctgagatgnggcgtatttagtactgtcagtcagttattaataactactccttacgacgttccggaccgaaagggacctaagggtagaaactacgaaacgtaagtcggtaggactcggactaacccagttacctgttaccttcgacttccctttacccggacctagtcctaacg

SEQ ID NO: 169664 - DNA, 548 bp, Homo sapiens
  misc_feature: GYAE6OF02GLNCX.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaacagcaagtccagccagactgttttatacagctccaacaataagaactacttagcttggtatcagcagaaaccagggcagcctcctaaactgctcatttactgggcatctacccgggagtccggggtcctgaccgattcagtgcagcgggtctggacagatttcactctcacatcaacagcctgcaggctgaggatgtggcgtatttattactgtcagtctagttattataatacctccgtccgtacgttacggaccgtaaagggacctaagggtacgaaaactacgaaaacgacgtggtacggacttcggaccaaccgtatccgttcgttaccttcactttcccttaccccgccttacgtctaacg

SEQ ID NO: 169665 - DNA, 732 bp, Homo sapiens
  misc_feature: GYAE6OF02IFX7F.37.11.A11.1.454.CMB.1.raw
  modified_base (176)..(176): a, c, t, g, unknown or other
  misc_feature (176)..(176): n is a, c, g, or t
  modified_base (227)..(227): a, c, t, g, unknown or other
  misc_feature (227)..(227): n is a, c, g, or t
  modified_base (229)..(229): a, c, t, g, unknown or other
  misc_feature (229)..(229): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
tcagtagtgtagatcacgaccggtgctcgatttagctacgactgcaggggcgagcaagagtggtgttgcacgacccgaggtcttctatttctctgttgctcgtggatctcgtggtcgccgtacggggacaccgtgatcgacccagtcctccagacctcccgtggctgtgtcttcgngggcgaggacgggccctcatacaactgacaacgccagccagacttgtttanananctaccaaanaaagtaaacaacttactagtcttggtatacagacaacgaaaaccgagggacacgacctaccttaaaacgtcactactaatttacgcggactaactccggtaaccgggacggtcccgggtccctagaaccgtcttacgtagggtcggccgagggtccgggttcggtacgggaactaaggttactttaccgacctttcctaaccaactaactaaccgaaacacggtcctcgacgacgggtcttagggaaggtaacgttgggtacgggactttaagttttaacttacggtagtcctaagggacttaaattaattaaacttaactacctcccgtacggtacccggtttcggaaccgaaacgggaacgtaacgggtaaggtaaaactacgaaaaaccgtaagtcgggtagtacgtcggaccaaacctcgttaccgttcggtttacctttaacctcgtttacccccgttaccccggactttaaccgttgtaaacccgg

SEQ ID NO: 169666 - DNA, 523 bp, Homo sapiens
  misc_feature: GYAE6OF02G2Z79.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttactgggcatctacccgggagtccggggtcctgaccgattcagtggcagcgggtctgggacagatttcactctcaccatcaacagcctgcaggctggaggatgtggcgtatttatactgtcagactagttaattataatactcctccgtacgttcggaccgaagggaccaagggtacgaaactcgaaaacgactgtagctacgcaccgtatcgtagtcttacacttcctcccgctatctaacg

SEQ ID NO: 169667 - DNA, 496 bp, Homo sapiens
  misc_feature: GYAE6OF02H4BPG.37.11.A11.1.454.CMB.1.raw
  modified_base (378)..(378): a, c, t, g, unknown or other
  misc_feature (378)..(378): n is a, c, g, or t
  modified_base (477)..(477): a, c, t, g, unknown or other
  misc_feature (477)..(477): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccggagtccggggtcctgaccgattcagtggcagcgggtctgggacagatttcactctcaccatcaacagcctgcaggctgaggntgtggcgtatttatactgtcagcagtattataatactcctcgcgttcggaccaggaccaaggtgaaatcaaacgactgtggctgcaccatctgtcttcntccttcccgctatctaacg

SEQ ID NO: 169668 - DNA, 526 bp, Homo sapiens
  misc_feature: GYAE6OF02GG10N.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatcctacccgggagtcccggggtcctgaccgattcagtggcagcgggtctggacagatttcactctcaccatcaacagccctgcaggctagaggatggtggcgtatttattactgtcagcagttattataatactcctccgtacgttccggacctaaggggaccaagggtagaaaactcgaaaacgtactggtagctgaccacctatctagtcttacacttcctcccgacctagtctag

SEQ ID NO: 169669 - DNA, 557 bp, Homo sapiens
  misc_feature: GYAE6OF02H67DS.37.11.A11.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctccaaacaataagaactacttagcttggtatcagacaagaaaccagggcagcctacctaaatgctcatttacnggcatcgtaccgggagtccgggtcctgaccgtnttcagtcggcaggcggtctgggacagtacttcactctacaccatcaacacgcctgacgnggctaggaggatggtgcgttaatttatcgtgtacagctaagttattaattaactacctaccgtaccgtacgtttccggaccgtaaagggaccgtaagggtagtaaactacaaaacgtacgtgacggtctagactacctatccgtagttccttcacttcccttcccgactactctaacg

SEQ ID NO: 169670 - DNA, 550 bp, Homo sapiens
  misc_feature: GYAE6OF02H8CS0.37.11.A11.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
  modified_base (521)..(521): a, c, t, g, unknown or other
  misc_feature (521)..(521): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctccaaacaataagaacttacttagcttggtatcagacaagaaaccagggcaacgcctacctaaactgctctaatttacngggcagttccgtacccggggagttcccggggtaccctggaccgtattcgaggtcggacnggcggtcgtggacagtattcactctcaccatcaaacncgtcctagcaggctagacggtatggtggctaagtttactactgtacagtctaagttattataactcctacctcgtacgttcggaccaagggaccaaggtacgaaatacgaaacgtagtgtaggctacgcacntctgtctcactccttcccgactatcgtaa

SEQ ID NO: 169671 - DNA, 744 bp, Homo sapiens
  misc_feature: GYAE6OF02HA8VY.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctgggcgagacgggcctccatcaactgcaagtccagccagactgttttatacagctaccaacaataagaacttacttagcttggtatcagcaagaaaccagggcacgcctacctaaactcgactctatttacgtgggactacgtccggtaccccggggtacggttccccggggtaccctacgggacccgtattaccgaggtcggaccgtacgggtcgggttcgtacgggaactacggttactttaccgaaccttccttaccgaacctactaccgaaactacgcccgttaggaccgtaacggccgtaagggacgggtaagttcgggtaggtaccgtttaattttaacgttacgtcgttacaggtactaagtttaacttaacttaacttacctacccgttaccggtaaccggtttacccgggaccgtaaacggggtaacccgtaaacgggttaacggaaaaccgttaacgaaaaaccggtacgttaggtcccgggtacgttaccggaacctaaccgtacgtttccgttacgtttacctttaccgtacctttacccccgttccccgtaacttacttacccgttaacg

SEQ ID NO: 169672 - DNA, 529 bp, Homo sapiens
  misc_feature: GYAE6OF02IFZFZ.37.11.A11.1.454.CMB.1.raw
  modified_base (219)..(219): a, c, t, g, unknown or other
  misc_feature (219)..(219): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagccccaanaataagaactacttagcttggtatcagcagaaaccagggcagcctcctaaaactgctcatttactgggcatctacccggggagtccggggtccctgaccgattcagtggcagcgggtctggggacagatttcactctcacatcaacagcctgcaggctaggaggatggtggcgtattttatactgtcagcagtattataattactcctccgtacgttccggaccgaaagggaccaaaggtacgaaataccgaaaacgaactgtcggactgcaacctatctgtcttcactccttcccgctactctagtaac

SEQ ID NO: 169673 - DNA, 860 bp, Homo sapiens
  misc_feature: GYAE6OF02H2FLW.37.11.A11.1.454.CMB.1.raw
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgaccagtctccagacctccctggctgtgtctctgggcgagagggcctccatcaactgcaagtccagccagactgttttanacagctccaacaataagaactacttagcttaggtatcagcaagaaaccagggcagcctacctaaactcgctacgtaatttacgngggctagtccgtaacccgggagttcccggggttcccctaggaacccgtagttaccaagggttcgggaccaacgggtccggggttacgttacgggaacgtaaggtaacttttccgaaacctttcccgtaactaaccctactaaccaaacgaccggtccctagaccgtaacgggtacctagggaacgggtacgttagggttacgggaccggtttaatttttaacgtttaaccgttacggtttacaacggtaccgttaaacggtttaatttaaacgttttaaacgttaacccttacccccgttttacccgggtaaaacccgggtttttccccggtaaccccggggaaaaccgggggttaaaccggtaaaaccggggtttaacggggtaaaaaccgtttaaaacccggtaaaaaaacccgtaaaccgggtttaaccggttacggggtaacccgtttacgggaaccccttaaacccggtaacgttaacccgtttacggttttacccgtttaccgttaaaccggtttccccgttttaaccccccggtacccttaacccgttccgtttaaacccgg

SEQ ID NO: 169674 - DNA, 554 bp, Homo sapiens
  misc_feature: GYAE6OF02H5QE8.37.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataaagaactacttagcttggtatcagcagaaaccagggcagcctacctaaactgctcatttacngggcatccgtacccgggaggtcccggggtcctgacccgattcgagtggacaggcgggtctgggacagtatttcactctcaccatacaactacgcctgcaggctggaggatggtggacgtaatttattacgtgtcagctaagttattaattaactacctccgtccgtacgttccggacgaaacgggaccaagggtacgaaactacgaaacgactgtggactcgaccaacctattcttgtaccttcacttcccttacccgctatctaacg

SEQ ID NO: 169675 - DNA, 552 bp, Homo sapiens
  misc_feature: GYAE6OF02GLOHQ.37.11.A11.1.454.CMB.1.raw
  modified_base (378)..(378): a, c, t, g, unknown or other
  misc_feature (378)..(378): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactctctggctgtgtctctgggcgagagggcctccatcaactgcaagtccagccagactgttttatacagctaccaaacaataagaactacttagcttggtatcagcaagaaaccagggcagcctacctaaactgctcatttactgggcatccgtacccgggagtcccggggtccctgaccgtattcgagtggcacggcgggtcgtgggacagtatttcactctcaccataccaancgcctgcgaggctggaaggtatggtgcgtatttattactgtcagtctaagttattaatactcctccgtaccgtacggttccggacctaaggggaccaaggtacggaaatacgaaacgtacgtgtacgacgtcgaccaactattcctgtacttcacttccctcccgtacacttcg

SEQ ID NO: 169676 - DNA, 901 bp, Homo sapiens
  misc_feature: GYAE6OF02GMEJU.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacggcctccatacaactgacaacgtccagacctagtactttagttttaacaacacgtacctaaccaaaactaaactaaacgtaaaccttaacgttacgtacgtttacgtaactacgaacgaacgaaaccgaaaccggacggacctacgtaccctaacctaaacgtcgtacttacgttaacgttacggtacggtaccgtaccggtacccgggtaaccccggggtaccgggttccccgggtaccgtaccggtaaccgttacgttacgacgggtcggtacggtacgggtcggtacggtacggtacgtacgttactacctaccgtacaccaactacaaccgtaccgtacgtaccgtacggacgtacgggtcgtaagggtactgggttaacgggttaacgttacgtttaaacgttacgttacgtaccgttaactaaggttaccttttaaagttaaccgtttaacccgttaccggtttacccctaaccgggggttaacccggttaaacccgggtacccggtaaaacggggtaaaccgggttaaacggtaaaacgggttaaaccgtaaaacccggttaacggtaaaccggttaccgggtagttacccggtaaccgttacccggtaaacccttaacccggttttacgttaaccccttttaaccggtttaccgttacccgtttaccccggttaaccccggtttacccgaaccgttttaccgttaaacccgtttaaccccgg

SEQ ID NO: 169677 - DNA, 676 bp, Homo sapiens
  misc_feature: GYAE6OF02J2V1T.37.11.A11.1.454.CMB.1.raw
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
tcagtagtgtagatcacgaccggtgctcgatttagctacgactgcagggcgagcaagatggtgttgcagacccaggtcttcatttctctgttgctctggatctctgtgcctacgggacacccgtgatgacccagtctccagactccctggctgtgtctctggccagaggcctccatcactgcagtccagccagactgtttacacagtctaccaanaaactaagaacttacttaacgctttggtaactcgaagcaagaaacccnggtacagccctacctaaactgtcctacgtatttaccgtgggactactaccgtacccggacgttcccggggtaccctggacccgtatttcgacgttcggaccctaggtccgggttcttacggggaccacgggttctttaccgacgttccgtaccaaccgtattaccgaaaccgtacgcccgttcgacgtaaccggcttacggaaccggttagttcggtacggttacgtagttttaaacgtcgttcgtacgtaggtactagttacgttactaacgtacctccgttacgacgtttcggaccgtacgggaacctaggtaccgtaactacgaaaccgtagtacgtcgtacgtcgaaccttacctagtaccgtttaccgtattccgacttcccttacccggccctagttcccttaacgg

SEQ ID NO: 169678 - DNA, 506 bp, Homo sapiens
  misc_feature: GYAE6OF02HI2NM.37.11.A11.1.454.CMB.1.raw
  modified_base (365)..(365): a, c, t, g, unknown or other
  misc_feature (365)..(365): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcaggcgggtctgggacagatttcactctcaccatcaacngcctgcaggctgaggatgtggcgtatttatactgtcagcagtattataatactcctcgtacgttccggaccaagggaccaaggtacgaaatcgaaacgacgtgtagctgcaccatctgtctcacttcctccgctatctacg

SEQ ID NO: 169679 - DNA, 503 bp, Homo sapiens
  misc_feature: GYAE6OF02HA33F.37.11.A11.1.454.CMB.1.raw
  modified_base (363)..(363): a, c, t, g, unknown or other
  misc_feature (363)..(363): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcatttactgggcatctacccgggagtccggggtccctgaccgattcagtggcaggcgggtctgggacagattcactctcaccatcaacngcctgcaggctgaggatgtggcgtatttattactgtcagcagttattataatactcctcgacgttcggaccaagggtaccaaggtgaaatcaaacgaatgtagctgcaccatctgtcttcactcctcccgactatctacg

SEQ ID NO: 169680 - DNA, 565 bp, Homo sapiens
  misc_feature: GYAE6OF02JCWHP.37.11.A11.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (553)..(553): a, c, t, g, unknown or other
  misc_feature (553)..(553): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggatcagcagaaaccagggcagcctacctaaactgctcatttacngggcactcgtaccgggagtccgggtcctgaccgtatcagtggcagcgggtctggacagtattcactctcacatcaacagccctgacgaggctaggaggtactggtaggcgtatttacgttatgtacagtcagttattataactacgtcctaccgacgtttacggacccgaaagggacccgtaaagggtagaaaacgtaccgaaaacgtacgtagggtcggtctacggacctaccgaattccttaggtcctttacgacttcccgtacccncctatcctaacg

SEQ ID NO: 169681 - DNA, 677 bp, Homo sapiens
  misc_feature: GYAE6OF02JFRZT.37.11.A11.1.454.CMB.1.raw
  modified_base (87)..(87): a, c, t, g, unknown or other
  misc_feature (87)..(87): n is a, c, g, or t
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
tcagtagtgtagatcacgaccggtgctcgatttagctacgactgcaggggcagcaagatggtgttgcagacccaggtcttcatttcnctgttgctctggatctctggtcgcctacggggacaccgtgatcgacccagtctccagactcctggctggtgtctcgtgggcgagacgggcctccatcaactgcaagtccagccagactgtttacacngctaccaaacaataagactacttagcttaggtancagcaagaaaccngggcagcctacaaatgctanatttacngggcagtccgtaacccgggaggttcccgggtcctagaccgtattaccgaagccggacgaacggtcggtcgtcggaacaggtactttcacttcacgacctaactccgaggtaccacggtccctaggtaccgtaagggtacccttaaggaaaacggttacgtcgggtttaacgggtaccttaaggtttttaaccgttcggtaacggttccgtaggtaccgttaacggtttaggtttaccggggtaacctcccggttacgggttaccgtttcggacggtacggaacggggtaccgtaaggtacggacgtaacgtacgtacgacgttaacgtggtcggactcgacgaaccgttgtaccgttcgttccaacgttaaccgttcccgtacccgacg

SEQ ID NO: 169682 - DNA, 520 bp, Homo sapiens
  misc_feature: GYAE6OF02GBCRP.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatcgtacccgggagtccggggtcctgaccgattcagtggcagcgggtctggacagattcactctcacatcaacagcctgcaggctagaggatggtggcgtatttatactgtcagtcagttattaataatactccgtccgtacgttcggaccgaagggaccaaggtcgaaatcgaaaacgactggagctgaccacatctcgttcttacacttcccttcccgactacgtctaacg

SEQ ID NO: 169683 - DNA, 531 bp, Homo sapiens
  misc_feature: GYAE6OF02ILFZ6.37.11.A11.1.454.CMB.1.raw
  modified_base (513)..(513): a, c, t, g, unknown or other
  misc_feature (513)..(513): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctccaaacaataaagaactacttagcttggtatcagcaagaaaccagggcagcctaccaaactgctcatttactgggcatcgtacccggggagtccggggtccctgaccattcagtgcagcggtctgggacagtattcactctcaccataccaaacacgcctgcagggcctggagatggtgcgttaatttatacttgtacagactagttaattaatacttacctctacgacgttcgggaccaagggacctaaagggtcgaaatcgaaaacgtactgtgactgctaccattctcgtcttcncttctcccgctatctacg

SEQ ID NO: 169684 - DNA, 507 bp, Homo sapiens
  misc_feature: GYAE6OF02FK908.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcacatcaacagcctgcaggctgaggatgtggctatttattactgtcagcagttattataatactcctcgacgttcggaccaagggaccaagggtacgaaatacgaaacgaacgtgtggctgcaccatctgtcttcactccttcccgctatctag

SEQ ID NO: 169685 - DNA, 500 bp, Homo sapiens
  misc_feature: GYAE6OF02HOMUH.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaagctgctcgtttactgggcctcgtacccgggaatccggggtccctgaacgattcagtggcggcggtctgggacagatttcactctcaccatcagcagcctgcgggctgaagatgtggtcggtttattactgtcagcagtattatgttactcctcactagtttggccgtagggaccaagctggagatcgcacgaagtgtgctgccaccatctgtcttcattcctcccgctatc

SEQ ID NO: 169686 - DNA, 633 bp, Homo sapiens
  misc_feature: GYAE6OF02I5QPM.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactggcaagtccagccagactgttttanacagctccaacaataagaactacttagcttgatcagcagaaaccaggcagcctacctaaactgctcatttactgggcagtcgtacccgggtagtccggggtccctggaccgtattcagtcggcaggcggtctggacagtattcactcgtacaccatcaacgacgcctagcgacggctaggagatggtcggcgtaatttacttactgtacagtctaagttattataactacctccttaccgacgtttccggaccgaacggggtaaccgtaagggtacggtaaaactaccgtaaaaaccgggtacttcgggtacgggaccttacggtaccctaaaccgtacgtttaccgttacggtttacccgtttaccttaacccgttttaccccgtttacccccggtacccttaaccgttacccgttaaacgg

SEQ ID NO: 169687 - DNA, 618 bp, Homo sapiens
  misc_feature: GYAE6OF02GZZ0Z.37.11.A11.1.454.CMB.1.raw
  modified_base (389)..(389): a, c, t, g, unknown or other
  misc_feature (389)..(389): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcaagaaaccagggcacgcctacctaaactcgactctatttacgtgggacactccgtaacccggggtacgtcccggggtcctcgaccgtattcgagtggcgaggtcggtcgtgggactaggtactttcgactctcacatacaacngcctgcgagcgtagaggtagtgtggacgttatttacgttacttcgtacagtactagttaattaataatacctaccgtaccgtacggtttaccggaccggtaacgggaccgtaagggtacggtaaactacgaaaacgtacgttaggtacggtactacggacctaaccgacttccgttacgttcctttaccgacgtttcccgttaccccgtaccttagttaccgttaacgg

SEQ ID NO: 169688 - DNA, 533 bp, Homo sapiens
  misc_feature: GYAE6OF02FZMEI.37.11.A11.1.454.CMB.1.raw
tcagtagtgtagatcacgaccggtgctcgatttagctacgactgcaggggcagcaagatggtgttgcagaccccaggtcttcatttctctgttgctctggatctctggtgccgtacggggacaccgtgatgacccagtctccagactccctggctgtgtctctgggcgaggagggcctccatcaactgcaagtccagccagacttgttttatacagctaccaaacaaataagaactacttagcttggtatcagcaagaaaccaggggcagcctacctaaactgctcatttactgggcatcgtacccgggagtcccggggtcctggaccgattcagtggcaggcgggtctgggacagtattcactctcaccatcaacagcctgcaggctggaggatggtggcgtaattttacttctgtcagcagttattataatacctcctccgtacgttcgggaccaagggaccaagggtacgaaatcgaaaacgtaatgtagctgcaccatctagtcttcattcccttccgcctatctaacg

SEQ ID NO: 169689 - DNA, 570 bp, Homo sapiens
  misc_feature: GYAE6OF02F7H4A.37.11.A11.1.454.CMB.1.raw
  modified_base (283)..(283): a, c, t, g, unknown or other
  misc_feature (283)..(283): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatccgtacccgggagtcccggggtccctggaccgattcaggtggcaggcgggtcgtggacagtatttcactctcaccataccaacngcctgcaggctggaggntggtggacgtatttacttactgtcagactagttattaataacttacctccgtaccgtacggttccggaccgaacggggtaccgaagggttacgaaataccgaaacgtaacgttggtacgctgaccaacctattccgttacgttaccttcctacttcccgttacccgaccttactctaacg

SEQ ID NO: 169690 - DNA, 622 bp, Homo sapiens
  misc_feature: GYAE6OF02F6PD2.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttaggtatcagcaagaaaccagggcacgcctacctaaaactgctctatttacgtgggcacgtccgtaccccggggaggtcccggggtccctacggaccgtagttcgaggtcggcgaggcgggtcgtagggacagtactttcacttctacaccatccaaacacggtccctgaccacgggctaggacggtagtggtaggtacgttaattttacgttaccgtgtcaggttactaagttacttaagttaacttacctacccgtaccgtaccggttaccgggaccgtaaacgggaccgtaaagggttagaaactacgaaaccgtaagtcggtacgcgtacgacaccattaccgtgttacttctacttaccctcccgtactactcgtacg

SEQ ID NO: 169691 - DNA, 650 bp, Homo sapiens
  misc_feature: GYAE6OF02JSU8I.37.11.A11.1.454.CMB.1.raw
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (398)..(398): a, c, t, g, unknown or other
  misc_feature (398)..(398): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctcaacaataagaactacttagcttggtatcagcagaaaccaggcagcctacctaaacngctcatttacngggcattccgtaacccggggagttcccggggtcccctaggacccgtattccgaggttggacctaaggccggggttctagggactaggtactttcacctcttacaccgtatccaaacngtcccctagacacgggaccttaggaacggtagtcgtacgggacgttaattttataacgtgtaccaggtactaaggttaattaactaaacgttcctacccgtaccgtaccggtttaccgggaccgtaaacggggtaaccctaagggtacggaaaacttaccgaaaaacgtaccgtggtacgccgtacggtaccaacccttatcccgttaagttccttacctagttccccttacccggtacctattacgttacg

SEQ ID NO: 169692 - DNA, 513 bp, Homo sapiens
  misc_feature: GYAE6OF02HB1OO.37.11.A11.1.454.CMB.1.raw
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaaacaataaagaactacttagcttggtatcagcagaaaaccagggcagcctcctaaactgctcatttactgggcatcctacccgggagtcccggggtcctgaccgattcagtagcagcgggtctgggacagtatttcactcctcaccatcaaacagcctgcaggctaggaggatggtggacgtatttacttactgtcagcagttattataatactcctcgacgttcgcgaaggcaaggtgaaancaaanacgtgtcgctcgcacctatctgtcttacgctccttcccgctatctacg

SEQ ID NO: 169693 - DNA, 614 bp, Homo sapiens
  misc_feature: GYAE6OF02JIP26.37.11.A11.1.454.CMB.1.raw
  modified_base (340)..(340): a, c, t, g, unknown or other
  misc_feature (340)..(340): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttggtatcagcaagaaaccagggcagcctcctaaactgctcatttactgggcatcctacccgggagtcccgggtcctgaccgattcagtggcagcgggtcgnggacagtattcgactctcacatcaacagcctgcaggctaggacgtatggtgacgtatttactactgtcagtactagttaatttactaataccgtcctaccggtacgttaccggtacccgaaacggggtaaccgtaacgggtacgtaaaacgttaacccgaaaaacgtaccgttagttacgggtaccgtacggtaccctaacccgtagtacccgtttacgtttcccttaccgttacttaccccgtttacccccgaccgttattccccgttaaacg

SEQ ID NO: 169694 - DNA, 631 bp, Homo sapiens
  misc_feature: GYAE6OF02JFV0I.37.11.A11.1.454.CMB.1.raw
  modified_base (283)..(283): a, c, t, g, unknown or other
  misc_feature (283)..(283): n is a, c, g, or t
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaccagggcagcctactaaactgctcatttacngggcatccgtaccgggagtccgggtcctggaccgattcgagtcggcaggcgggtcgngggacagtacttcactctcaccatacaacncgcctgcgagctggaggatggtggacgtatttacttactgtaccagtcgtagttaacttaacttaactacctcccgttaccggtaccggtttaccgggaacccgtaaacgggggaacccgtaaaggggttacggtaaaacttaaaccggaaaaccggtacgttggtacgggtccgtacgaccctaacccgtagttcccgtttaggttacccgttttaccaccgtttccccttaccccggtacccttacttacccgttaacg

SEQ ID NO: 169695 - DNA, 494 bp, Homo sapiens
  misc_feature: GYAE6OF02FGSL2.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatctacccgggatccggggtcctgaccgattcagtggcagcggtctggacagattcactctcacatcaacagcctgcaggctgagatgtgcgtatttattactgtcagcagtattataatactcctcgacgttcggccaagggacctaaggtacgaaatcaaacgactgtgctgcacatctgtcttcactccgttccgctatctacg

SEQ ID NO: 169696 - DNA, 523 bp, Homo sapiens
  misc_feature: GYAE6OF02IU4YM.37.11.A11.1.454.CMB.1.raw
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttgtatcagcagaaaccagggcagcctcctaaaactgctcatttactgggcacttcgacccgggagtccggggcctgaccgattcagtcggcagcgggtctggacagattcactctcacatcgaacagcctgcagctgaaggntgngcgatttatactgtcagacagttatataatctcctcgacgttcgacctaagggacctaaggtgaaaactcaaaaccgtaatggtacgcttacggcaaccattccgtagttccttcacgttcttacccggcctactctaacg

SEQ ID NO: 169697 - DNA, 566 bp, Homo sapiens
  misc_feature: GYAE6OF02IJQY0.37.11.A11.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (408)..(408): a, c, t, g, unknown or other
  misc_feature (408)..(408): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctccaacaataagaactacttagcttggtatcagcaagaaaccagggcagcctacctaaactgctcatttacgnggcatccgtacccgggagtcccgggtcctggaccgtattcaggtggcgaggtccgggtcgtcgggactagtactttaccacttctaccactatcaaacagccctgcaggctgagatgtggnttatttatactgtcagctagttattataactcctcctccgtacgttcgaccgaagggacaaggtacgaaactacgaaaaccgtacgtgtaggctacggctaaccgtattccgtcgttacctttacctacttcccgttaccccgacttacgtcctaacg

SEQ ID NO: 169698 - DNA, 670 bp, Homo sapiens
  misc_feature: GYAE6OF02HKTSP.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataaagaacttaacttagcttggtatcagacaagaaaccagggcagccctacctaaactgctctatttacgtgggctacgtccgtacccggggtaggtcccggggtccctcggaccgtattcgaggtcgcgacggcgggtcgtagggaccagtactttcaccttctacctaccatacaaacgacgccgtagcgaggtcctaggaagtagttaggtggtacttaaggttttattccgttcgtcgtggtcgtagtttacgttttcgggtaccttccgtaccgggtaccgtttcggccgtacggacgggtaaccggtagggttacggaacgtacgtaacgaacggtacgtaaccgttgggttacggcggttacgaccgttaaccgtacgttccgttcggtttactttcccgtaaccgttttcccccgttaccccggtaccctttaaccgg

SEQ ID NO: 169699 - DNA, 606 bp, Homo sapiens
  misc_feature: GYAE6OF02GB6XZ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagccttggtatcagcagaaaccagggcagcctactaaactgctcattactggcatcgtacccgggagtccgggtcctgaccgattcgagtgcgagcggtctggacagtattcactctacactatacaacgacgcctgctaggctagacggatcggtggtacgtatttagttaacctggtacagactaagttattaagtaaactccttacccgtaccgtacggttacggaccgtaaacgggaccgtaagggtagaaactacgaaaaccgtaacgtggttacggacttaccggaccaaacccgttacgttaccgttacgtttaccctttaccgtaaccgttcccgtttacccccgaccttacgttccgttaacg

SEQ ID NO: 169700 - DNA, 630 bp, Homo sapiens
  misc_feature: GYAE6OF02H05G3.37.11.A11.1.454.CMB.1.raw
  modified_base (210)..(210): a, c, t, g, unknown or other
  misc_feature (210)..(210): n is a, c, g, or t
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttanacagcctaccaaacaaataagaaacttacttagcttggtatcagcaagaaaccgagggcacgccttacctaaactcgctactaatttacgngggactagtccggtacccggggacggtcccgggggtccctggaccgtattcaggtggcgaggcgggtntcgggacagtacttcactctcaccatacaacacgctgcaggtctaggaggatggtggtacgttattttactacttgtactagacttagttaattaacttaaactaccctaccgttacccggtaaccggtttaccgggaacccgtaaaggggaacccgtaaaggggtaacgtaaaacgtaaccgaaaacggtacgttggtcggactcggaacaccctattcctacgtctttacgacttcccttcccgacctactattaaccg

SEQ ID NO: 169701 - DNA, 496 bp, Homo sapiens
  misc_feature: GYAE6OF02G53T9.37.11.A11.1.454.CMB.1.raw
  modified_base (363)..(363): a, c, t, g, unknown or other
  misc_feature (363)..(363): n is a, c, g, or t
  modified_base (476)..(476): a, c, t, g, unknown or other
  misc_feature (476)..(476): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagattcactctcaccatcaacngcctgcaggctgaggatgtggcgtatttatactgtcagcagtattatatactcctcgacgttcgacaagggaccaaggtgaaatcaaacgactgtgctgcacatctgttctcncttccttcccgctatctacg

SEQ ID NO: 169702 - DNA, 550 bp, Homo sapiens
  misc_feature: GYAE6OF02IKHJ1.37.11.A11.1.454.CMB.1.raw
  modified_base (286)..(286): a, c, t, g, unknown or other
  misc_feature (286)..(286): n is a, c, g, or t
  modified_base (388)..(388): a, c, t, g, unknown or other
  misc_feature (388)..(388): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctgactgtgtctctgggcgagagggcctccatcaactgcaagtccagccagactgttttatacagctccaaacaataagaactacttagcttggtatcagcaagaaaccagggcagcctacctaaactgctcatttacngggctatcgtacccggggagtccggggtcctgaccgattcagtggcaggcgggtctggacagtattcactctcacatacaacacgcctgcaggctggaaggntggtggcgtatttactactgtacagctaattattaataactactccgtccgacggttacggaccgtaaacgggacctaagggtagaaaactcgaaaaacgtacttggacggctagcaaccgattccttgttaccttcaacttcctccccgactactctaacg

SEQ ID NO: 169703 - DNA, 583 bp, Homo sapiens
  misc_feature: GYAE6OF02IRYIU.37.11.A11.1.454.CMB.1.raw
  modified_base (403)..(403): a, c, t, g, unknown or other
  misc_feature (403)..(403): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagcctccaacaataagaactacttagcttggtatcagcagaaaccagggcagcctacctaaactgactcatttactgggcatcgtaccccgggaggtcccgggggtccctcggaccgtattccgagttcggcaggtcggtcgtgggaacagtatttcactctcaccatcaacacgcctagcaggctggaggntggtggcgtaatttatactgtacagtcagttacttataacttacctccttacgacgttaccggaccgaagggtacctaagggtagaaactaacgaaaacggacttacggtaggcttacgaccgtaccaacgtccttcggttaccttacctacttcccgttaccccgacttactcgtaacg

SEQ ID NO: 169704 - DNA, 520 bp, Homo sapiens
  misc_feature: GYAE6OF02G6F6O.37.11.A11.1.454.CMB.1.raw
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacgngggcatccgtacccgggagtccggggtcctgaccgattcagtggcaggcggtntggacagattcacgtctcacatcaacagcctgcaggctggaggatgnggctaatttatactgtcagctagttatataactactcctaccgtcgtacgacgaacgggtacaaggtacgaaactacaaacgtatggtacgngtacgctaacctntctcgttactctactcctcccgctatctacg

SEQ ID NO: 169705 - DNA, 567 bp, Homo sapiens
  misc_feature: GYAE6OF02F4UTN.37.11.A11.1.454.CMB.1.raw
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctctatttactgggcagtccgtacccgggacgtccggggtccctagaccgtattcagtggcaggcggtcgtggacagtattcactcgtcaccatcaacagctgcaggctaggagtntggtaggngtatttattactgtcagtactagttattataaacttccgtacctccggtacgttcggaccgaaagggaccaagggtacgaaatacgaaacgactgtgacgtaggcctaccgtattccgttagttaccttactaccgtttacccgtacccgaccttactaccgttaacg

SEQ ID NO: 169706 - DNA, 595 bp, Homo sapiens
  misc_feature: GYAE6OF02JB3CX.37.11.A11.1.454.CMB.1.raw
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
  modified_base (355)..(355): a, c, t, g, unknown or other
  misc_feature (355)..(355): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctcatcaactgcaagtccagccagactgtttanacagctccaacaataagaactattagcttggtatcagcaagaaccagggcaagcctactaaactgctactatttacngggcatccgtacccgggagtcccgggtcctggacccgtattcaggtcggcacggtcgggtcctagggaaccnggtaattccgactcgtacacgatacaacagctgcaggctagaggtatggtggacgttattttactacgtagtaccagacttagtatttataactaccttccgtaccgtacggtttaccggaccgtaaacgggacctaaagggtcggtaaaacttacccgaaaggttaactcggtggtacctggtaacccaccttagtccgtacgttacttcgacttcccgttcccgactacgttcgtaac

SEQ ID NO: 169707 - DNA, 651 bp, Homo sapiens
  misc_feature: GYAE6OF02HK6HZ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttggtatcagcaagaaaccagggcagccctcctaaactgctctatttactgggcatccgtacccgggaggtcccggggtccctcggaccgattcgagtcggcaggtcgggtcgtgggacaggtatttacacttctcacctactaccaacacgcctagacgagggcctaggacggtagttcgggtggtacgttaattttacgttaactggtaccaaggtcttaagttaatttaactaaacttaccttacccgttaccggaccggtttaccgggaacccgtaacggggtaacccgtaaagggttaacggtaaaacttacccgaaaacgtaaccgtagtacgggtacttcggaccacctaagttcccttacgtttccttactaccgttcccgttaccccgacctacgtaccgtacg

SEQ ID NO: 169708 - DNA, 516 bp, Homo sapiens
  misc_feature: GYAE6OF02JGVB0.37.11.A11.1.454.CMB.1.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacngcctgcaggctggagntggtggacgtatttacttactgtcagctagttattaatatacctcctccgtacgttcgaccgaagggaccaaggtagaaactacgaaacgtactggtcgctcgcaccatctgtctcattcctacccgctatctacg

SEQ ID NO: 169709 - DNA, 612 bp, Homo sapiens
  misc_feature: GYAE6OF02FKWTF.37.11.A11.1.454.CMB.1.raw
  modified_base (372)..(372): a, c, t, g, unknown or other
  misc_feature (372)..(372): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactgctcatttactgggcatcgtacccgggagtcccggggtccctgaccgattcagtggcaggcgggtctgggacagtatttcactctcaccatcaaacngcctgcaggctaggaggattggtaggcgtatttatactgtcagtactagttattaataacttaccttcccgttccgtaccggttacggacccgaaacggggtaaccgtaagggttaacggaaaactaccgaaaaccggtaacgttaggtacgggtaccgttaggaccctaaccgtaacttaccgttagtttccgttacctaccgttaccccgtttaccccgaccctacgttccttaacgg

SEQ ID NO: 169710 - DNA, 515 bp, Homo sapiens
  misc_feature: GYAE6OF02H1TZV.37.11.A11.1.454.CMB.1.raw
  modified_base (317)..(317): a, c, t, g, unknown or other
  misc_feature (317)..(317): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (481)..(481): a, c, t, g, unknown or other
  misc_feature (481)..(481): n is a, c, g, or t
  modified_base (510)..(510): a, c, t, g, unknown or other
  misc_feature (510)..(510): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaaccagggcagcctcctaaactgctcatttactgggcatcctaccgggagtccgggtcctgaccgnttcagtggcagcgggtctggacagattcactctcacatcaacagcctgcaggctgaggatgtggcgtatttatactgtacagctagttattanaatcncctacgacgttcgccgaaaggaccaaggttagaaactacgaaacgtacgtgacgctagccaacctntcttagtcttcacttccttcccgctactntaacg

SEQ ID NO: 169711 - DNA, 512 bp, Homo sapiens
  misc_feature: GYAE6OF02HSPRK.37.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttacngggcatcgtacccgggagtccggggtccctgaccgattcagtggcaggcgggtctgggacaggtactttcacttctcaaccatacaacagcctgcaggctggaggatggtaggcgtatttactactgtcagctagtattataatctctccgagttcgacgaaggaccaaggtagaaatacaaacgtacgtgngactcgcacntctgtcttcactcctccgactatctag

SEQ ID NO: 169712 - DNA, 680 bp, Homo sapiens
  misc_feature: GYAE6OF02HQNYT.37.11.A11.1.454.CMB.1.raw
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
tcagtagtgtagatcacgaccggtgctcgatttagctacgactgcagggcagcaagatggtgttgcagacccaggtcttcatttctctgttgctctgatctctggtgcctacgggacaccgtgatgacccagtcctccagacctccctggctgtgtctcgtgggcgagagggccctcatcaactgacaagtccagccagtacttgttttanacagcctacaaacaataaagaacttacttagnttaggtatacagacaagaaaaccgagggacaacggtcctaacctaaaactcgacttccaatttttaaccgcgggacctaacttaccggtaacccccgggaggtttaccccgggggttcccctaggaacccggtactttccgaaggtcggcaacgggcgggttaccgngggaacctaaggtattttccgaactttccacaaccctatacaaacacggttcccngaccgaggntaggaggtagtcggacggttattaagtttaacttacgtgtagacgtactaagttaattaataactccgtcgtaccgtcggtaccgaacgaacgaacgtaaggaagtaaacaaacgtaaaacgtaacgtggtacggactcgaaccaaccgtactactttaccgtgttacctccgtttaccccgttccccgaacttaccttagtaacg

SEQ ID NO: 169713 - DNA, 614 bp, Homo sapiens
  misc_feature: GYAE6OF02JKQRR.37.11.A11.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgtttttanacagctacccaanaaataagaacttaccttagctttggtaatcagcaacgaaaccagggcacgccttacctaaactgctcatttactgggcattcgacccgggtacgtccgggtccctgaccgattcgagtggcacgcgggtctggancgtattcactcncacgatccgaancgctancgacgntgagntgtgcgtattattacngactagacgtagttaacttataattccctccgttaccggctttaccggaccggtaaacgggtaaccgaagggtttaggaaaactcgtaaaaaccgcttagggtcgaaccgttcgaaacccgaacccttaagtcccgtttcggtttaaccctttaccgtaactttaccccgttacccccgtcccgaattttacgaaccgg

SEQ ID NO: 169714 - DNA, 549 bp, Homo sapiens
  misc_feature: GYAE6OF02HF0CP.37.11.A11.1.454.CMB.1.raw
  modified_base (283)..(283): a, c, t, g, unknown or other
  misc_feature (283)..(283): n is a, c, g, or t
  modified_base (416)..(416): a, c, t, g, unknown or other
  misc_feature (416)..(416): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatccgtacccgggagtcccggggtcctcgaccgtattcagtggcaggcggtctggacagatttcactctcaccatccaacacgcctgcgaggctaggaggtagtggtggtcgtatttagttactgtacngtactagttattataattcctccgccgtacggttcggaccaacgggacaaggtagaaactacgaaacgtacgtgtacggctcgctaccagtccttcgttcctttacacgttcccttccccgactacgtctacg

SEQ ID NO: 169715 - DNA, 582 bp, Homo sapiens
  misc_feature: GYAE6OF02HCYGE.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttactgggcatctacccgggagtccgtggtccctgaccattcagtgcagcggtctgggacagtattcactctcaccatcaacagcctgcaggctggacggatggtcggcgtatttaagttactgttcaagtccgtaagttattaacttaaatacccttcccgtaccggttaacggttccgacgtaaacgggaaccgtaaggttaacggaaactacgaaacgtaacgtggtacggacgttcgacctaacctaacttccgttacttccgtttaacctaccttccggttaccccactacgttaccg

SEQ ID NO: 169716 - DNA, 519 bp, Homo sapiens
  misc_feature: GYAE6OF02GSP13.37.11.A11.1.454.CMB.1.raw
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
  modified_base (366)..(366): a, c, t, g, unknown or other
  misc_feature (366)..(366): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctccaacaataagaactacttagcttggtatcagcaagaaaccagggcagcctacctaaactgctctatttacngggcatccgtacccgggagtcccggggtcctgaccgattcagtggcagcgggtctggacagtattcactctcacatcaacngcctgcaggctaggaggattggtggactatttactactgtccagtcagttattataatcctcctcgtacgttcgaccgaaggaccaaggtagaaactcgaaaacgactgtcgctagacactatctgtcttacacttcctcccgctatcgtaac

SEQ ID NO: 169717 - DNA, 576 bp, Homo sapiens
  misc_feature: GYAE6OF02HSKXK.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctccaacaataagaactacttagcttggtatcagcagaaaccagggcagcctctaaactgctcattactggcatcgtaccgggagtccgggtcctgaccgattcagtgcagcggtctggacagtacttcactctcacatcaacagcctgcagctgaggatgtggctatttactactgtacagtactagttaatttaataacttacctcccgttaccgtacggtttaccggaccgtaaacggggtaccaagggttacgaaacttaccgaaaacgtacgttggtacggcttacggacctaacccgtataccgttacgttacctttaccgactttccccgtttaccccggtacctacgttcctaacgg

SEQ ID NO: 169718 - DNA, 549 bp, Homo sapiens
  misc_feature: GYAE6OF02HHWZW.37.11.A11.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcagaaaccagggcagcctacctaaactgctcatttacngggctatccgtacccgggaggtcccggggtcctcggaccgattcgagtggcaggcgggtctgggacagtatttcactctcaccatacaacagcctgcaggctgaggntgnggtntatttattacgtgtcagctagtattanaatctcctcgacgttccgaccgaagggaccaagggttanaaactacgaaaacgtagtggtaggactcggaccaccgtattccgttacgtccttcacttcccgttccccgactacgttctaacg

SEQ ID NO: 169719 - DNA, 610 bp, Homo sapiens
  misc_feature: GYAE6OF02IPRSE.37.11.A11.1.454.CMB.1.raw
  modified_base (210)..(210): a, c, t, g, unknown or other
  misc_feature (210)..(210): n is a, c, g, or t
  modified_base (278)..(278): a, c, t, g, unknown or other
  misc_feature (278)..(278): n is a, c, g, or t
  modified_base (391)..(391): a, c, t, g, unknown or other
  misc_feature (391)..(391): n is a, c, g, or t
tcagtagtgtagatcacgaccggtgctcgatttagctacgactgcagggggcagcaagatggtgttgcagacccaggtcttcatttctctgttgctctggatctctggtgccgtacggggacaccgtgatgacccagtcctccagcctccctggctgtgtctcgtgggcagaggcctccatcaactgcaagccagccagacttagtttanacagcctaccaaacaataagtaactacttagcttagatcagacaagaacaggctacgcctactaactnctatagttactggacactacggtacccggacggtccgggtcctagaccgtactacgacggtgacgacggtcggtcgtggacagtacttccactctacactatacacacgtcgngacgagctagaggatggtacggacttaatttcgtaacgtcgttaccgaaggttctaagttaacttaactaaaccgttacctacccgtaccggtacgttacccgggaacggaacggtaaccgtaaggttaccgtaaaattacccgaaaagtaccgtagttcggctacgaccgtacattccgtacttctacgttctaccgtaccacgttactaccgtaacg

SEQ ID NO: 169720 - DNA, 542 bp, Homo sapiens
  misc_feature: GYAE6OF02G37L5.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactcttttgtcagcgtcgacaataagaactactttgcttggtaccaacagaaagcaggacagcctcctaagttgctcatttactcggcatcccacccgggcacgtccggggtccctgaccgattcagcggcaggcgggtctgggacagatttcactctcaccatcagcagcctgcaggctagaagatgtggctagtttatttctgtctgtctagttagtttgggtacctccgtcggtactttcggcgtcgagggaccgtagggtggagacgtacaaggtcgagttacggtggcttcggaccaccgtattccgttcggttccttactacttcccgttcccgaccg

SEQ ID NO: 169721 - DNA, 534 bp, Homo sapiens
  misc_feature: GYAE6OF02FZXKY.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatctacccgggagtccggggtccctgaccgattcagtggcagcgggtctgggacagattcactctcaccatcaacagcctgacaggctgaggatggtggcgtatttattactgtcagcagttattataatctacctcgtacgttcggccaaagggacccaagggttcgaaataccgaaaacgtaactgtacggcttcgacctaccatcgtacgttcttacactttccgtacccgtcctactcttacg

SEQ ID NO: 169722 - DNA, 580 bp, Homo sapiens
  misc_feature: GYAE6OF02HHRFT.37.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccagggcagcctacctaaactgctcatttacgngggcatccgtacccgggagtcccggggtccctgaccgattcagtggcaggcgggtcngggacagtatttcactctcacatcaaacagccctgcgaggctggagagtgtggacgtaatttagtactgtcagtctagttattaataactacctcctaccgacgtttaccggaccgtaaagggacctaagggtaggaaaactaccgaaaacgtacgtggtacgctaggacctaaccacgttccttaggttccctttacgtacctttcccgttaccccggacttacgttaccgtaacg

SEQ ID NO: 169723 - DNA, 557 bp, Homo sapiens
  misc_feature: GYAE6OF02IOVID.37.11.A11.1.454.CMB.1.raw
  modified_base (287)..(287): a, c, t, g, unknown or other
  misc_feature (287)..(287): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaaacaataagaactacttagcttggtatcagcaagaaaccagggcagcctacctaaactgctcatttacngggcagtccgtacccggggagtcccggggtccctgaccgattcgagtggcaggcgggtctggacagtattcactctcacatacaacngcctgcaggctggagntgtggctatttatactgtcagctagtattataactctcctcgacgttccggacgaacgggacctaaggtacgaaaatcgaaaacgtacgttggtacggctacggtccaacctattccgtacgttcctttactacgtttcccgttaccccgaccttagtccttaacgg

SEQ ID NO: 169724 - DNA, 578 bp, Homo sapiens
  misc_feature: GYAE6OF02H9L93.37.11.A11.1.454.CMB.1.raw
  modified_base (278)..(278): a, c, t, g, unknown or other
  misc_feature (278)..(278): n is a, c, g, or t
  modified_base (334)..(334): a, c, t, g, unknown or other
  misc_feature (334)..(334): n is a, c, g, or t
tcagtagtgtagatcacgaccggtgctcgatttagctacgactgcaggggcagcaagatggtgttttgcagacccaggtcttcatttctctgttgctctggatctctggtgcctacggggacaccgtgatgacccagtctccagactccctggctgtgtctctgggcgagaggcctccatcaactgcaagtccagccagactgttttatacagcctccaaacaaataagaacttacttagcttggtatcagcaagaaaccagggcagcctcctaaacngctcactttactggcactcgtacccggacggtaccgggtccccgtcgacgacttcngtgcgagcggtacgtggacgagtagttcactctcaacctactacaacagccgtctacgacgactcggaaggagtgtggtacgtatttattacgtgtacagactagtaattaactaattactccgtacgtaccgttacggtaccgaacgggaacgtaacgtagggtaaactacgtaaacgaactgtaggcgtcgactaccgtactcgttctacctctacttccgttcccgtactacgtactaacg

SEQ ID NO: 169725 - DNA, 641 bp, Homo sapiens
  misc_feature: GYAE6OF02GMQ78.37.11.A11.1.454.CMB.1.raw
  modified_base (301)..(301): a, c, t, g, unknown or other
  misc_feature (301)..(301): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaaataagaactacttagcgttaggtatcagacaacgaaaccgagggacacgacctaccgtaaactgctactatttacgngggactacgtccggtacccgggacggtcccgggtacctgaccgtatcgagtgcgaggcgggtcgtagggacagtacttcgacctctacaccataccaaacgcgtcctgacgaggtcaggtaggagttggtacggtacgttatttaacttacgtagacgtagtactaagtttaacttaataacgttaccctccgtaaccggttaccggtaccggtaaccgaacgggtaaccgtaaggttaagaaaactaccggaaaacgttcggtagcgtcctaacggacctaacctattccgttactaccgtttacacccgtttaccctaccccgtactacgttctaacg

SEQ ID NO: 169726 - DNA, 595 bp, Homo sapiens
  misc_feature: GYAE6OF02JP10E.37.11.A11.1.454.CMB.1.raw
  modified_base (283)..(283): a, c, t, g, unknown or other
  misc_feature (283)..(283): n is a, c, g, or t
  modified_base (432)..(432): a, c, t, g, unknown or other
  misc_feature (432)..(432): n is a, c, g, or t
  modified_base (556)..(556): a, c, t, g, unknown or other
  misc_feature (556)..(556): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactactagcttggtatcagcagaaaccagggcagcctacctaaactgctctatttacngggcagtaccgtaccgggagtccgggtccctacggaccgattcgagtgcgaggcggtcgtggacgagtattcactctccaccagtacaacacgtcctagcacgggctacggaggattcggtggtacgttaattttaattacgtcgtacngtacgtagttaattataattacctcccgtacgtaacgttccggtaccgaacgggtaaccgtaacggtagaaaccgtacgaaaacggtagtacggtagcgtacggactacccgtattaccggttntaccgtttacacgtttcctacccggtcctagttctaacg

SEQ ID NO: 169727 - DNA, 514 bp, Homo sapiens
  misc_feature: GYAE6OF02H2VWL.37.11.A11.1.454.CMB.1.raw
  modified_base (208)..(208): a, c, t, g, unknown or other
  misc_feature (208)..(208): n is a, c, g, or t
  modified_base (333)..(333): a, c, t, g, unknown or other
  misc_feature (333)..(333): n is a, c, g, or t
  modified_base (381)..(381): a, c, t, g, unknown or other
  misc_feature (381)..(381): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccgggtcctgaccgattcagtggcagcgggtntggacagattcactctcacatcaacagcctgcaggctgaggatggtgngtatttatactgtcagctagttattataatactcctcgacgttcgccgtaaggacctaaggtgaaactacaaacgtacgtgtacgctgccacctatccttagtcttacacgttccttacccgctactctaacg

SEQ ID NO: 169728 - DNA, 619 bp, Homo sapiens
  misc_feature: GYAE6OF02G880S.37.11.A11.1.454.CMB.1.raw
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctccaacaataagaactacttagcttggtatcagcaagaaaccagggacagcctacctaaactgctcatttacngggcagtcgtacccgggagtcccggggtccctagaccgtattcagtcggcgaggcgggtctgggacaggtactttccaacgttcctacgaacctataccaaacagtccctggccaacgggcctagggaaggtagttcggtagggtaccttaattttacgttactggtacaagtctagttaattataaacttcctaccgtaccgtacggttccggaccgtaaaggggacctaagggtacgaaaactaccgaaaacggtatacggtaggacctaggacccaacctagtccgttacgttcttaccacgtttccctaccccgacttactaccgtaacg

SEQ ID NO: 169729 - DNA, 620 bp, Homo sapiens
  misc_feature: GYAE6OF02F7UGF.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttaggtatcagcaagaaaccagggcagcctacctaaactgctcatttactgggcatcgtacccgggagtccggggtcctgaccgtattcagtggacaggcgggtctgggacagactttcactctcacactacaacagtccctgacaggctaggaggatggtggactaattttactaacgttgtacgtaggtactaacgttaatttaagtaaacttaccttaccgttacccggtaaccggtttcccgggaacccgtaaagggggaaccctaaagggttacggaaaacttacggaaaacgtaaccgtggtacgtacgtacggtaaccaaccgtaacgttcgtacgttaccttacgaacttcccttacccgacctatccgttaacg

SEQ ID NO: 169730 - DNA, 552 bp, Homo sapiens
  misc_feature: GYAE6OF02HVTBM.37.11.A11.1.454.CMB.1.raw
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
  modified_base (511)..(511): a, c, t, g, unknown or other
  misc_feature (511)..(511): n is a, c, g, or t
  modified_base (541)..(541): a, c, t, g, unknown or other
  misc_feature (541)..(541): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaacaataagaactacttagcttggtatcagacagaaaccaggggcagcctacctaaactgctcatttacngggcattccgtaacccggggnggtcccggggtccctggaccgtattccagtggcaggcgggtctagggacagtactttcactctacaccatacaacagcctgcagctgagtatggnggactatttatactgtacagtctagttattataatacctccgtcgtacgttcgacgaacggacgaaggtagaaactacgaaacgtacgtaggtcgactcgcaacctntaccttgtcttaccacgttcccttaccccnctactctaacg

SEQ ID NO: 169731 - DNA, 573 bp, Homo sapiens
  misc_feature: GYAE6OF02HYBYY.37.11.A11.1.454.CMB.1.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (539)..(539): a, c, t, g, unknown or other
  misc_feature (539)..(539): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctccaaacaataaagaactacttagcttaggtatcagcaagaaaaccgagggcacgcctacctaaactgctcatttacnggctatcgtacccggggagtcccggggtcccnggacctattcgagtggcaggcgggtctgggacagtacttcactctcaccatacaacacgcctagcgaggctggagtgttggagggtacgttattttactacgtgtacagtactaaggttattaataactacctcccgtaccgtacggttaccggaccgaaacggggtaccaagggtacgaaactaacgaaacgtaacgtggtagactgaccacngtctcgtcttcacttcccttacccgctactctac

SEQ ID NO: 169732 - DNA, 602 bp, Homo sapiens
  misc_feature: GYAE6OF02IKQ6P.37.11.A11.1.454.CMB.1.raw
  modified_base (208)..(208): a, c, t, g, unknown or other
  misc_feature (208)..(208): n is a, c, g, or t
  modified_base (287)..(287): a, c, t, g, unknown or other
  misc_feature (287)..(287): n is a, c, g, or t
  modified_base (371)..(371): a, c, t, g, unknown or other
  misc_feature (371)..(371): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctacaaacaataagaactacttagcttggtatcagacaagaaccagggcagcctacctaaactgctcattttacngggcagtcctacccggggacgtcccggggtccctgaccgtattcgaggtcggcacggcgggtctgggacagtactttcacttcncactatcaacacgcctgcaggctaggagagtggtgacgttaatttacgttacgttgtactagtctaagtttacttaattaactacctccgttaccgaccggtttaccgggaccgtaaaacgggaaccgtaaagggtacgtaaaactaccgtaaaaacgaccgttggacggacttaggacccaactataccttgtaccgttctacgttcccttacccgcctacctacgtacg

SEQ ID NO: 169733 - DNA, 589 bp, Homo sapiens
  misc_feature: GYAE6OF02FWG8X.37.11.A11.1.454.CMB.1.raw
  modified_base (208)..(208): a, c, t, g, unknown or other
  misc_feature (208)..(208): n is a, c, g, or t
  modified_base (351)..(351): a, c, t, g, unknown or other
  misc_feature (351)..(351): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttggtatcagcaagaaaccagggcacgcctacctaaactgactctatttactgggctacgtccgtaccccggggagtcccggggtcctagaccgtattcagtggcagcgggtcnggacagtattcactctcaccatccaacacgcctgacaggctagacggatggtaggtcgtatttattacgtgtcaggtctagttaacttaataacttaccttccgtaaccgtacgtttaccgggaccgtaaacgggacctaagggtacggaaactacgaaacgtactggtacgacctgaccaaccgtattccgtcgttctttaccactttcccgttaccccgccttacttcgttaaccg

SEQ ID NO: 169734 - DNA, 538 bp, Homo sapiens
  misc_feature: GYAE6OF02JB0HG.37.11.A11.1.454.CMB.1.raw
  modified_base (285)..(285): a, c, t, g, unknown or other
  misc_feature (285)..(285): n is a, c, g, or t
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctcatttacngggcatcgtacccgggagtccggggtccctggaccgattcgagtggcaggcgggtctgggacagtattcactctcaccatcaacagcctgcaggctagacggntggtggactatttattacngtcagctagtattataactctcctccgacgttcgaccgaagggacctaaggtacgaaactcgaaacgtactgtcgctacggacacctagtctcgtcttaccgacttcccgttacccgacctactacgtacg

SEQ ID NO: 169735 - DNA, 637 bp, Homo sapiens
  misc_feature: GYAE6OF02IQ0OY.37.11.A11.1.454.CMB.1.raw
  modified_base (265)..(265): a, c, t, g, unknown or other
  misc_feature (265)..(265): n is a, c, g, or t
  modified_base (391)..(391): a, c, t, g, unknown or other
  misc_feature (391)..(391): n is a, c, g, or t
  modified_base (455)..(455): a, c, t, g, unknown or other
  misc_feature (455)..(455): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctccagactccctggctgtgtctcgtgggcgagagggcctccatcaactgggcaagtccagccagacttgttttactacagcctaccaaacaaataacgaactacttagcttggtatcagcaagaaaccnggcagcctactaaatgctcatttacctaggcagtcgtacccgggtacgtcccggggtcctagaccgtattcgagtcggcaggtccgggtgtcgggacagtatttcgactctaccactatacaaacncgccctgcgtacggactgggtaacggagttcggtacggtacggttaaattttacgtttaaccgngtacagtaacgttaagttaatttaactaactccgttacccgtacgttacggtaccggtaaccgaaacgggtaccgtaaagtaaggaaactaccgaaaacgtacgttcggacgtaccgtacgaccgtaactacgttcgttacgttcttaccaccttccgttacccgaccttacgttacctacg

SEQ ID NO: 169736 - DNA, 652 bp, Homo sapiens
  misc_feature: GYAE6OF02I6PIM.37.11.A11.1.454.CMB.1.raw
  modified_base (210)..(210): a, c, t, g, unknown or other
  misc_feature (210)..(210): n is a, c, g, or t
  modified_base (619)..(619): a, c, t, g, unknown or other
  misc_feature (619)..(619): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttanacagctaccaacaataagaacttacgttagcttggtatcagcaagaaaccgagggccacgcccttacctaaacgtgacctctatttacgtgggacctacgttccggtaacccggggtacggtcccggggtccctaggacccgtattcgaggtcggacgacgggtcgggtacgtgggaacagtaactttccactccttaccaaccaacgtaccaaaccgtacgtcccgtaggaccgtaggcgtagggaacggagttgggtacggtacgttacttttacttacgtagtcgtaacgtattagttaacttaacttaacttaccgtacccgttaccggttaccgttacccgggaaccgtaacgggaaccgtaagggtacgaaactaccgaaagtacgtagtcgctacgctaccntctacgtctacgcttaccgccctcactctaacg

SEQ ID NO: 169737 - DNA, 735 bp, Homo sapiens
  misc_feature: GYAE6OF02HE1GD.37.11.A11.1.454.CMB.1.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctaccaacaataagaactacttagcttggtatcagcaagaaaccgagggcacgcctacctaaactgctactatttacgngggactactccgtacccggggacgtcccggggtccctacggaccgtattccgaggttcggacgagggtccgggtcgtacgggaacaggtactttccgaacttctaccaacctataccaacacgcctagccgaaggcctaggaagggtagttcggtagggtaccgttaagtttttaacgttacgtcgttaccgaggtaccttaaagtttaactttaaacgttaaacttacccgttccccgttaacccggttaccggtttacccgggaacccgtaaaacgggggtaacccgtaaaaggggttacggtaaaaacgttaacccgaaaaaccgggtaacgttggggttaccggtacctaccgggtaaccctaccgtaactttcccggttacgttaccctttaccttaaccgtttccccgtttacccccggacctttacgttccgttaacg

SEQ ID NO: 169738 - DNA, 562 bp, Homo sapiens
  misc_feature: GYAE6OF02IRBI3.37.11.A11.1.454.CMB.1.raw
  modified_base (392)..(392): a, c, t, g, unknown or other
  misc_feature (392)..(392): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctacctaaactgctcatttactgggcatccgtacccggggaggtcccggggtccctggaccgtattcgagtggcaggtcgggtctgggacagtattcactctacacatcaacagcctgcaggctgaggntggtggagtatttattactgtacagctagttattataactactcctcgacgttcgaccgaagggactaagggtagaaactcgaaaacgtcgtaggtcggactacgactaacctagttcgttacgttactttcgtaactttcccttaccccggtacttaccgtacttaacg

SEQ ID NO: 169739 - DNA, 579 bp, Homo sapiens
  misc_feature: GYAE6OF02FOOCB.37.11.A11.1.454.CMB.1.raw
  modified_base (400)..(400): a, c, t, g, unknown or other
  misc_feature (400)..(400): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataagaactacttagcttggtatcagcaagaaaccagggcagcctacctaaactgctcatttacgtgggctatccgtacccgggaggtcccggggtccctggaccgattcgaggtggcaggcgggtcgtggacagtatttcactctcaccatacacacgcctgcaggctaggaggtntggtggtctatttattacgtgtcgagtctagttattaatacttacctccgtaccgtacgttacggaccgaagggtaccgaaggtacgaaatacgaaacgtactgggtacgtcgtacgcctaaccgtactccgttacgttccttacgtacttcccgttaccccgcttaccttcgttaacg

SEQ ID NO: 169740 - DNA, 547 bp, Homo sapiens
  misc_feature: GYAE6OF02JFGD9.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcatttactgggcatctacccgggagtccggggtcctgaccgattcagtggcagcgggtctgggacagtatttcactctcaccatcaacagcctgcaggctaggaggatggtggcgtatttattactgtacagctagttattataatacctcctaccgtacgttccggaccgaacgggactaagggtacgaaataccgaaacgtaacgtggtagtcgtacggcaacctagtcgtacgttccttactacttccttaccccgacttactcgtaacg

SEQ ID NO: 169741 - DNA, 490 bp, Homo sapiens
  misc_feature: GYAE6OF02F5RIP.37.11.A11.1.454.CMB.1.raw
  modified_base (383)..(383): a, c, t, g, unknown or other
  misc_feature (383)..(383): n is a, c, g, or t
  modified_base (441)..(441): a, c, t, g, unknown or other
  misc_feature (441)..(441): n is a, c, g, or t
  modified_base (485)..(485): a, c, t, g, unknown or other
  misc_feature (485)..(485): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttactgggcatctacccgggagtccggggtcctgaccgattcgagtggcaggcgggtctgggacagattcactctcaccatcaacagcctgcaggctgagatgngtctatttatatgcagcagtattatatctcctcgacgttcgcaaggacaaggtgaaancaaagactgtgctgcacatctagtctcacttcctacccgctatntaacg

SEQ ID NO: 169742 - DNA, 730 bp, Homo sapiens
  misc_feature: GYAE6OF02G8017.37.11.A11.1.454.CMB.1.raw
  modified_base (139)..(139): a, c, t, g, unknown or other
  misc_feature (139)..(139): n is a, c, g, or t
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
  modified_base (317)..(317): a, c, t, g, unknown or other
  misc_feature (317)..(317): n is a, c, g, or t
  modified_base (419)..(419): a, c, t, g, unknown or other
  misc_feature (419)..(419): n is a, c, g, or t
  modified_base (706)..(706): a, c, t, g, unknown or other
  misc_feature (706)..(706): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtccncgagtcctccgngctgtcgtctcggngggacgaggccggtccctactactaccaacgtcgaactaccgtaccgaccgaccaacgttacgttttagtttaacacgctacctaaccaaactaaagtaaactaacctttagtacgttacgttaggtactacgacgacgaaacgaaaccggnggacaccgtacctaaaccgtaagcctactagttaacgtttacggcggactacgttacccgggtaaccggtccgggttcccggtacctacggaccttatacgngggtcgacgtcggtcggtgtacggatacgttctacgctcaccactctaacacgacgtcacgcgacggtctacgggtagtttagttcgtaacgttttatttacgtctacgcgtaagtacgttaagtttaattaactaccttcccgtaccgtacccggttacggtccggtaaaccggaaggttaaccgtaaaggtaacgtaacttaaaccggaaacttggtacgtccgtactacacccgaacttacgtacgttaccgttaccgtaagtttccccgttaccgttaccccngttaacttaccggtattaaacccg

SEQ ID NO: 169743 - DNA, 621 bp, Homo sapiens
  misc_feature: GYAE6OF02HKEZ7.37.11.A11.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (369)..(369): a, c, t, g, unknown or other
  misc_feature (369)..(369): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctacctaaactgctcatttacngggcatcgtacccgggagtccgggtccctgaccgtatcgagtggcaggcgggtctgggacagtactttcactctcaccatcaacncgcctgcaggctgaggtatggtggacttatttacttactgtacagtctagttaattaataactacctccttaccggtaccggtttaccggaccgtaacgggtaccgtaagggttacggaaaactaccgaaaaccggtaacgttcgggtacggaccgtttacggaccctaacccgtacttacccgttacggtttacccttttaccgtaactttccccgtttaccccccggtaccttacgttaccgttaacccg

SEQ ID NO: 169744 - DNA, 640 bp, Homo sapiens
  misc_feature: GYAE6OF02I7TIW.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggccctccatcaactgcaagtccagccagactgttttatacagctccaacaataagaactacttagcttggtatcagcagaaaccagggcagcctacctaaactgctcatttactgggcatcgtacccgggagtccgggtcctgaccgattcagtgcagcggtctggacagatttcactctacacactacaacacgcctgacgtacggcttcggaaggagttggtagggacttaatttattacgtgttaccgagtctaaggttaattaagttaaactaccttcccgttaccgtaccgggtttacccggaaccgtaaacggggtaacccgtaaagggttaacgtaaaacgtaccgaaaaaccggtaacttagggacggtacgtacggaacctaacccgtagttaccgttaggtttacctttaccggacctttacccggttaccccgtacccgttaacttaccgttaaccgg

SEQ ID NO: 169745 - DNA, 507 bp, Homo sapiens
  misc_feature: GYAE6OF02GBAP4.37.11.A11.1.454.CMB.1.raw
  modified_base (408)..(408): a, c, t, g, unknown or other
  misc_feature (408)..(408): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctcctaaactgctcatttactgggcatcgtacccgggagtcccggggtccctgacccgattcagtggcaggcgggtctgggacagatttccactctcaccatcaacagcctgcaggctgaggatgtggcgtattttatactgtcngctagttattataactactcctcgcgttcggacgaagggacaagggtagaaatcaaacgactgtgctgcacntctgtcttncttcctccgctatcctag

SEQ ID NO: 169746 - DNA, 570 bp, Homo sapiens
  misc_feature: GYAE6OF02HOAXH.37.11.A11.1.454.CMB.1.raw
  modified_base (208)..(208): a, c, t, g, unknown or other
  misc_feature (208)..(208): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctcaacaataagaactacttagcttggtatcagcagaaaccaggcagcctacctaaatgctntatttacnggcatccgtaccgggagtccgggtcctgaccgattcagtggcaggcggtctggacagtacttcactcncacatcaacacgcctgctaggctaggaggtacgtggtggtactatttactacgtgtacagtctagtaattataactacctcccgtacgtaaccggttccggaaccgtaaacggggaaccctaagggtacgaaactacgaaaacgtactggtacggcttacgacctaaccgtatccgttacgtacttcaacttccgttaccccggacttacgtccgtaacg

SEQ ID NO: 169747 - DNA, 595 bp, Homo sapiens
  misc_feature: GYAE6OF02G69T4.37.11.A11.1.454.CMB.1.raw
  modified_base (208)..(208): a, c, t, g, unknown or other
  misc_feature (208)..(208): n is a, c, g, or t
  modified_base (290)..(290): a, c, t, g, unknown or other
  misc_feature (290)..(290): n is a, c, g, or t
  modified_base (590)..(590): a, c, t, g, unknown or other
  misc_feature (590)..(590): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaaacaataagaactacttagcttggtatcagcaagaaaccgagggcagcctacctaaactgctctatttacgngggcagttccgtacccggggacggtcccggggtccctggaccgtattcgagtcggcgaggcgggtcgtgggacaggtactttcgacttctacacctataccaaacgcgcctagcgacggtcgtaggaggagttggtggtcgttaatttacgttactgtacagtacttaagttaattataacttacctcctccgtacggttccggaccgaagggaaccgtaaggtacgtaaataccgtaaacgacgtggtacgctacggacacctatcgttagttccttcacttcccgttcccacttactntaacg

SEQ ID NO: 169748 - DNA, 670 bp, Homo sapiens
  misc_feature: GYAE6OF02GBU7W.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctaccaacaataagaactacttagcttggtatcagacaagaaaccgagggcacgcctacctaaacgtgacctactatttacgtagggctacgtaccgtaacccggggacgtcccgggggtacccctaggacccgtattcgaggttcggacgacggtcgggtcgtaggggacaggtactttccgacgtctaccacctactacaacgcgacctcgacgaggcctaggaggtagtcggtacggacgttagtttaattacgtgtacgaaggtactaagtttattaactaaactaccgttaccgtaccggtaccgttaccgggaccgtaaacgggtaaccgtaacgggttaacgtaaactaccggtaaaacgtaccgtaggtacgacttaccggacctaacctacgttaccgttacggttacccttaccgtacgtttacccttcccgacttacgttacctaacg

SEQ ID NO: 169749 - DNA, 669 bp, Homo sapiens
  misc_feature: GYAE6OF02HWSSY.37.11.A11.1.454.CMB.1.raw
  modified_base (310)..(310): a, c, t, g, unknown or other
  misc_feature (310)..(310): n is a, c, g, or t
  modified_base (423)..(423): a, c, t, g, unknown or other
  misc_feature (423)..(423): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatcaactgcaacgtccagccagtacttgttttaatacagcctaccaaactaaataaacgaacttacttagtcttaggtactcagacaagaaaccgagggcacgcctacctaaactcgtctactattacgnggtctacgtaccggtaccggggacggtcccgggtcctacggtaccgtattaccgaggtcggacgtacgggtcgggttcgtaggacagttacttccactctacactactacacncgctcgcgacggcgtaggaggtagttgggtacggtacgttagttttaacgtcgtcgtactaagtacttaagttaaactttaacttaacttccgtacccgttcggtaaccggttacccggaaccgaaacggggtaaccgtaaagggtaacgtaaactaaccggaaacgttacgttcggtacgactacggaacctaccgtattccgttaacgtcttacgtcttccccgttaccgctacgtacttaacg

SEQ ID NO: 169750 - DNA, 790 bp, Homo sapiens
  misc_feature: GYAE6OF02HNW0N.37.11.A11.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgttttanacngctccaacaataagaactacttagcttggtatcagcagaaaccagggcagcctacctaaangctcatttacngggcactccgtaacccgggagtcccggggtccctaggaccgtattccgaggtcggcgaggcgggtctgggacagtacttcacttcgtacacctagtaccaaacgtacgcccttaggacctacgggaccttagggaacgggtaagttcgggtacgggggtaccttaaagttttttaacgttaccgttacggttaccgtaacggtaaccgtttaaagttaaacgtttttaaaccttaaaaccgtttacccgttttaaccccccggttaacccggggttaaacccgggtttttacccgggggaaacccctaaaaccggggggggtaaaccccttaaaaggggggttaacggtaaaaaaccgttaacccggaaaaaaaccggttaacccgtttagggtaccgggttaccgttaccggtaacccgaaccgttacgttacccgtttacggtttaccttaccgttacctttacccccgttacccccggaccttaacccggttacgttaaaccc

SEQ ID NO: 169751 - DNA, 528 bp, Homo sapiens
  misc_feature: GYAE6OF02JGN7F.37.11.A11.1.454.CMB.1.raw
  modified_base (283)..(283): a, c, t, g, unknown or other
  misc_feature (283)..(283): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttacngggcatctacccgggagtccggggtcctgaccgattcagtggcagcgggtctggacagtattcactctcaccatcaacacgcctgcaggctagaggatggtggctatttattactgtacagctagttattataatacctcctcgacgttcggaccgaagggaccaaggtagaaactacgaaaacgtactggtgactggccacctatcctgttccttacacttcccgttcccgacctactctaacg

SEQ ID NO: 169752 - DNA, 705 bp, Homo sapiens
  misc_feature: GYAE6OF02H2TN6.37.11.A11.1.454.CMB.1.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (662)..(662): a, c, t, g, unknown or other
  misc_feature (662)..(662): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttanacagctaccaacaataagaactacttagctttggtatcagcaagaaaccagggccacgccctacctaaacgtgccttactaacttttacnggggacctacgttccggtaaccccggggacggttccccgggggttaccctcggtaacccggtatttccgaggttcgggaccacgggtccggggtacgttacggggaacctaggtactttaccaccgtttccgttaccaacctacgtacccaaaccgtacggtccttacggcgtaacgggtcgttacggggaaggttacgtcgggtacgggtacgtttaattttacgttaacgttgtaccgaagtacgtaaggttaatttaactaaacttccgtacccgttaccggtaccgtttaccggaccgtaaagggaaccctaaggtacgaaactaccgaaacgtaacgtgtacggactggaactaccngtactcgttaccttcaccgttccttacccgactactacgtacg

SEQ ID NO: 169753 - DNA, 691 bp, Homo sapiens
  misc_feature: GYAE6OF02HQMOI.37.11.A11.1.454.CMB.1.raw
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctaccaacaataagaactacttagcttggtatcagacagaaaaccngggcagcctactaaactgctcatttacgngggctataccgtaccgggacggttcccggggtccctacggaccgtattcgagtggactagggtcgggtacgtgggacgagtacgtttacacgttccttacgaaccctaataccgaaacacggtacccctaggaccgtaacggggccttacgggaagggtaacgttgggtacggggtaccggttaaatttttaacgtttaaccgttggttacaggttaccttaaggttaattttaaagtaaaccttaccttaccccgttaccggtaacccgggttttacgggacccgtaaacggggtaacccgaagggttacggaaaactaacgaaaaccgtactagggttcgacgttacgacctaccaagttcctgttacctactacgttcccttacccgaccttagtcttaacg

SEQ ID NO: 169754 - DNA, 640 bp, Homo sapiens
  misc_feature: GYAE6OF02FNF4N.37.11.A11.1.454.CMB.1.raw
  modified_base (405)..(405): a, c, t, g, unknown or other
  misc_feature (405)..(405): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagacttgttttatacagcctaccaaacaaataagaactacttagtcttggtatcagcaacgaaaccgagggcacgtccctacctaaactgctactatttacaggcatcgtacccgggcgtccgggtcctgaccgattcagtggcaggcgggtctggacagtattccactctcacctactcaactacgcctgcacgggtcgtaggaacggntcgggttcggacgtttaattttaacgttacgtcggtacgtacggtacgtaagtttaactttaactaaacgttaccttcccgttaccgttaaccggttccgggaccgtaaacggggtaccgtaaagggttacgtaaaactaccgtaaaacgtacgtcggtacgactcggacctaccgtatccgttgttaccctttactacgtttaccccgtcccgtacccttagttacccgtaacg

SEQ ID NO: 169755 - DNA, 603 bp, Homo sapiens
  misc_feature: GYAE6OF02JXR7P.37.11.A11.1.454.CMB.1.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
  modified_base (554)..(554): a, c, t, g, unknown or other
  misc_feature (554)..(554): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctaccaacaataacgaactacttagcttaggtactcagcagaaccgaggcagacctacctaaactgactactattacgnggactatccgtaccgggacgtcccgggtcctggaaccgtagtacgagtggacgaggtcggtcnggacagtacttcactcacacatacacacgccctgcgacggcgtacggagagttggtcgtacgttattttacgtacttcgtacgagtactagttaactttaacgtaacttaccgtcccgtaccgttaccggtcgaaccgtaacgggacgtaacggttacgtaaacgtacgaaacgtacgtacgtcgtactcggaaccaactntaccgttacgttcgttactccgttaccgttcccgacgtagttactaacg

SEQ ID NO: 169756 - DNA, 684 bp, Homo sapiens
  misc_feature: GYAE6OF02HYKI9.37.11.A11.1.454.CMB.1.raw
  modified_base (348)..(348): a, c, t, g, unknown or other
  misc_feature (348)..(348): n is a, c, g, or t
  modified_base (394)..(394): a, c, t, g, unknown or other
  misc_feature (394)..(394): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtcctccagacctccctggcctgtgtctcgtgggcgaggacgggccctccatcaactgacaacgtccagccagtactttgtttaacacgacgcctaccaaacaaaataaagaaaccttacttagctttaggactacagtacaacgaaaacccgagggacacgacctacctaaacgtgactactaatttacgcggacagttccgtaacccgggngtcccgggtacctcggaccgtatccgaggtcgcgacggtcgggtcncgggaactgtacttcacgttctacgaacctatacaaacgcgcgtagccgtagctacggagtagtcgtaggtacgtaattttagtacgttggtacaggtactaagttacttaagtaactcctacccgttacggtaccggttaccggaccgtaaacgggtaaccgtaaaggggtaacgtaaacgtaaccgaaaacgggacttacggtacggacggtaccgtaaccgtaaccgtacttacttacgttcccgtttacaccgttcccgttaccccgacttaccgttacgtaaccg

SEQ ID NO: 169757 - DNA, 574 bp, Homo sapiens
  misc_feature: GYAE6OF02F9VD9.37.11.A11.1.454.CMB.1.raw
  modified_base (353)..(353): a, c, t, g, unknown or other
  misc_feature (353)..(353): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaaataagaactacttagcttggtatcagcagaaaccagggcagcctacctaaactgctcatttactgggcatcgtacccggggagtcccggggtccctgaccgattcagtggcaggcgggtcgtggacagntttcactctcaccatcaacacgcctgacgaggctagaggatggtggactatttattacgtgtcagtctagttattataactcctccgtcgtacgttcggaccgtaacgggaccaagggttacggaaactaccgaaacgtaccgtggtaggctggacctaaccgttactccgttaggttcctttaccgtacgttccccgttaccccgcctacttccgtaacg

SEQ ID NO: 169758 - DNA, 625 bp, Homo sapiens
  misc_feature: GYAE6OF02I1RLG.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaccaggcagcctacctaaactgctcatttactgggcatcgtacccgggaggtcccggggtcctggaccgtattcgagtggcgagcgggtctcgggacaggtatttccacttctacacatacaacgacgccgtgcgaggcctaggaggtatggtcggacgttaattttacgttaccgtgtacgaggtctaagttaattaataacttacctcccgtaccgtacgttaccgggaccgtaaacggggtaaccgtaaagggtacgtaaaactaccgaaaaacggtaccgttggtacggacttacgaccgtaaccctagtccgttacgttaccgtttaccactttccccgttaccccgaccgttacttaccgttaaccg

SEQ ID NO: 169759 - DNA, 672 bp, Homo sapiens
  misc_feature: GYAE6OF02G38DQ.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttactgggcatcgtacccgggagtccggggtcctggaccgattcagtggcaggcggtctgggacagactttcacttctacaccgtataccaacacgtcctgcgtacgggctggaaggatcggtggtacgtagttttacgttaccgttggtacaaggtcctaagtttaatttaacgttaaacttacccgtttacccgttacccggtaaccggtttaccgggacccgtaaaacgggggtaaccccgtaaaggggtttacgtaaaacgttacccgaaaaaccggtaaccgttaggtacgggtacctttacggaccctaacccgtagttacccgttacgttccgttttacctacgtttcccgttttaccccccggacgttaccgttcccgttaacgg

SEQ ID NO: 169760 - DNA, 533 bp, Homo sapiens
  misc_feature: GYAE6OF02F4V34.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggatcagcagaaaccagggcagcctcctaaactgctcatttactgggcatctaccgggagtccggggtccctgaccgattcagtggcagcgggtctgggacagatttcactctcaccatcaacagcctgcaggctgaggatggtgcgtatttactactgtcagtcagttattataatacctccgtccgtacgttcggaccaaacggggacccaagggttggaaaatccgaaaacgacctgtaggactagccaccacttccgtagttccgttcacttccgttacccgctatctacg

SEQ ID NO: 169761 - DNA, 726 bp, Homo sapiens
  misc_feature: GYAE6OF02I0812.37.11.A11.1.454.CMB.1.raw
  modified_base (206)..(206): a, c, t, g, unknown or other
  misc_feature (206)..(206): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctggcgagaggcctccatcaactgcaagtccagccagactgttttanacagctaccaacaataagaactacttagcttggtatcagcaggaaaccagggcacgcctacctaactgctctatttacgtgggctagtccgtaccgggtacggtcccggggtccctacgaccgtattccgaggtggacgacggcgggtctgggactaggtactttccacgttcctaccacctaactaccaacgacggtaccctcgacctacggggctacgggtaaggtaggttcgggtacgggtacgttaattttaacgtttacgtacggtaccgtaggtacgtaaggtttaactttaacttaaaccgttacccgttaccccgttaccggtaaccggtttacccgggaacccgtaaacgggggaacccgtaagggttaacggtaaaaaccgttaccgtaaaaaccgggtacgttaacgggtacggtacgttaccggaacccgttaacccgtagttccgttacggtttacttacccgtacctttacccgttacccccgtactaccgtttaccgttaaccgg

SEQ ID NO: 169762 - DNA, 657 bp, Homo sapiens
  misc_feature: GYAE6OF02GS889.37.11.A11.1.454.CMB.1.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagcctaccaacaataagaactacttagcttggtatcagcaagaaaccagggacacgcctacctaaaactgactctaatttaaccgnggggactactccgtaaccccggggaggttcccgggggtccctaggaacccgtattccgaaggttcggacgaggccgggtacttacggggaactaggtactttaccactttctaccaacctataccaaacacgccgtagaccgaaggtctaggaggtataggtcggacgttaatttattacgtcgtacgagtactaagttaacttaagtaaactaccttacccgtaccgtacggtttaccggaccgtaaacgggactaaagggtacgaaaactacgaaaacgacgttaggtacgtactacgaccgtaacctaacttcgttacgtaccttacgtacttcccgttacccgtccctatcgttaac

SEQ ID NO: 169763 - DNA, 644 bp, Homo sapiens
  misc_feature: GYAE6OF02G1W82.37.11.A11.1.454.CMB.1.raw
  modified_base (209)..(209): a, c, t, g, unknown or other
  misc_feature (209)..(209): n is a, c, g, or t
  modified_base (263)..(263): a, c, t, g, unknown or other
  misc_feature (263)..(263): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagcctaccaaacaaataaagaacttacttagcttggtatcagcaagaaaccngggcagccctacctaaactcgctactaagtttactgggctaatccgtaaccccgggaggtcccggggtacctgaccgtattcaggtcggcaggcgggtctgggacagtatttcacttcacaccataccaaacncgccctgacacgggctaggaggngttggtggacgttaattttacttacgtgtacgaagctaagttaacttattaaacttacctccgttacccggtaacggtttaccgggaaccgtaaacggggacctaaggttacgggtaacggaaaactaccgtaaaacgtacgttggtacggtacgtcgaacctaaccgtaacgttccgttacgtttacctttccgtaacttcccgtttaccccgacgttactacg

SEQ ID NO: 169764 - DNA, 733 bp, Homo sapiens
  misc_feature: GYAE6OF02J2I2P.37.11.A11.1.454.CMB.1.raw
  modified_base (155)..(155): a, c, t, g, unknown or other
  misc_feature (155)..(155): n is a, c, g, or t
  modified_base (330)..(330): a, c, t, g, unknown or other
  misc_feature (330)..(330): n is a, c, g, or t
tcagtagtgtagatcacgaccggtgctcgatttagctacgactgcagggggctagacaagaggtggtgttgtcagacccagggtcttcactttcctcctgttgctctggatactcggtggtggccgtacggggactaccgggtggactcgacccngttcctccagaccgtcccgtggacctggtcggtctcgtgggaccgaggagggccctccatccaacgtcgactaacggtccacggtcccacgtccttctttttacacctacgtccttacccaaacaacttaacgaaccttacgttacgccttgggtactcgacgtcacgaaaccgnggctacgcccctacgtaaactccgcctactacgttacgtcgggcctaccgtccgtacccgggaggttcccggggtccacggaccgtacttcgaggtcggacgtgggccggttcgacggcagtaccttcgtccgactacgtacactaacgacgacgtccgtcgacgtcgaacgttggacggtaccttggtaaccgggacctttacgtttaaaccgttactccgtcgacgtaccgtacgtttaagttactaaacccttaccgtacctacccgggtacgtttacccgggaccgtaaggggaacccgttaaggtacggaaacttccggaaaactcgtacggcgtacgactcccggtactgtccctgttaccctttcaccgtacgtttccccgacttcgtccgtaacg

SEQ ID NO: 169765 - DNA, 561 bp, Homo sapiens
  misc_feature: GYAE6OF02IVQLS.37.11.A11.1.454.CMB.1.raw
  modified_base (287)..(287): a, c, t, g, unknown or other
  misc_feature (287)..(287): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcaagaaaccagggcagcctacctaaactgctcatttacgnggcatcgtacccgggagtccgggtcctgaccgtattcagtggcaggcgggtctgggacagtactttcactctcaccatcaaacncgcctgcaggtcnggaggntggtgcgttatttactactgtacagtctagttattaataactcctccgtaccgtacggttccgacgtaacgggacctaaggtagaaactacgaaaacgactaggtacgctcgactaacctacttcgttcgttccttacgtaccttcccgtaccccgacctacgtcctaacg

SEQ ID NO: 169766 - DNA, 825 bp, Homo sapiens
  misc_feature: GYAE6OF02G6XSX.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctcatcaactgcaagtccagccagtacttgttttacacacgtcctaccaaacaaattaacgaacttacttaagctttaggtatcagtcaagaaaccagggcaggccctactaaactgcctctatttactgggctacgtccgtacccgggacggttcccggggtccctacggaccgtagttaccgaggtccggcacgggtccgggtcgtacggggaacctacggtactttaccgaaccgtttccctacccgaaccacgtttaccgaacggtaccgtaacccggtcccgtttacggaccgtaacgggtaccgttacggtaaacggtcggtttacgggtacggtaccgttttaaacggttttacgttttccgttacgggttaccttacggttacgttacgggtttttaaccgggtttaccgggtttacccgtttacccggttaccgggtttaccggttttaccggggacccgggtaaccggtaaccgggggttaaacccgttaaggggggtttaaccgggaaacgttaacggtaccggtaaacgggttaccggaacgggtttcggtacccgggtacgttacggtaaccctaccgggtttacttaccggttaacggtttccttaccgtaaccgtttccccgtacccgttaacccg

SEQ ID NO: 169767 - DNA, 579 bp, Homo sapiens
  misc_feature: GYAE6OF02FH77M.37.11.A11.1.454.CMB.1.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
  modified_base (391)..(391): a, c, t, g, unknown or other
  misc_feature (391)..(391): n is a, c, g, or t
  modified_base (431)..(431): a, c, t, g, unknown or other
  misc_feature (431)..(431): n is a, c, g, or t
tcagtagtgtagatcacgaccggtgctcgatttagctacgactgcaggggcagcaagatggtgttgcagacccaggtcttcatttctctgttgctctggatctctgttactacaggtgcctacgggacatcgtgatgacccagtctccagacctccctggctgtgtctcgtgggcgagacgggccacgatcaactgcaagtccagccagtacctcttttgtcagcgtcgaacaataacgaacttactttgcttaggaaccaacagaaagcaggacagcctctaagtnctacatttacnggacatcgtaccgggngtccgggtccctgaccgnttccagtcggcaggtcgggtctgggactagtactttcgactccgtacaccatccaaacncgcctgacgaggtctagaggtatgtcggactattagttcngtacagtcagttattaactaactacctccgtaccggacgttccggaccaaacggggtaaccaaagggtgaaactacgaaaccgatcggtaggcctacggaccgtaacctagttccgttcgtaccgttcaaccgttcccgttcccgacc

SEQ ID NO: 169768 - DNA, 649 bp, Homo sapiens
  misc_feature: GYAE6OF02JXP8S.37.11.A11.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtgtctctgggcgagagggcctccatcaatgcaagtccagccagactgttttanacagctaccaanaataagaactacttagacttgtatcagcaagaaaccaggcagcctcctaaacngactcattactgggacagtcgtacccggaggtcccgggtcccngacccgattcgagtcggacagcgggtctagggacagtattcgactctacacctancctaacacgcctgacacggctcggaaggnttggcggtacgttaactttacgtttacctaggttcccgaagtctaagtttaacgtaattaacctaacgtcccgttacgaaccggtttaccggaccgtaaaccggggaacctaacgggtaaacgtaaaactaccgtaaaaccgtaaacttcgggtaggtaccgtacgtaccgtaacccggtaaatttcccgtaggttacccttcgtaacccgttcccgtttaacccccggacccttaattccgttaaaccgg

SEQ ID NO: 169769 - DNA, 697 bp, Homo sapiens
  misc_feature: GYAE6OF02I8VW1.37.11.A11.1.454.CMB.1.raw
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
tcagtagtgtagatcacgaccggtgctcgatttagctacgactgcaggggcagcaagatggtgttgcagacccaggtcttcatttctctgtcgctctggatctctggtgcctacggggacaccgtgatggacccagtctccagacctccctggctgtgtctcgtgggcgaggacgggcctccatcaactgcaagtccagccagacttagttttactacagcctaccaaacaattaaacgaacttaaccttagctttaggtaactcaggacaagaaaccgngggacacgaccctactaaactgacctactaacttttacgngggacacgttccggtacccggggtagtcccggggtcctaggacccgtattcgagtcgggcgagggcgggttcgtacgggactacggttactttaccaccgttctacccgaacctataccgaaacacggtccctgaccgtaggcgttaggaacggtgtgggtacggtacttaagttttacttacgtagtaccaaggtactacggttaacttaagttaacctaccgtaccgttacccggtaacgttcccggaaccgtaaacggggtacctaaacggggttacgaaacgtaaccgaaacgtaacgttcggacgttaccgacggtacctaacgttactcgtacgttacctcgtacttccccttaccgcctagttctaaccg

SEQ ID NO: 169770 - DNA, 696 bp, Homo sapiens
  misc_feature: GYAE6OF02IJWLO.37.11.A11.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (293)..(293): a, c, t, g, unknown or other
  misc_feature (293)..(293): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggagggcctccatcaactgcaagtccagccagactgtttanacagctaccaanaataagaactacttagcttggtatcagacaagaaaccgagggcaagcctacctaaactgctactatttacgnggacacgtccgacccgggtagtcccgggtcctggaccgtattcgaggtcggacacggcgggtctacgggactaggtactttccaacttctacgaacctacgtaccaaacgtacgccgtacgcgtaacgggtctaggtaacgggtattgggtcggtaacgttaacttttacgttaccgtaggtctaacggtacttaagttaattaacgtaacttaccgtcccgttaaccggtaccggttaccgggaacccgtaaagggggaaccctaaacggggttacgtaaaaccgttaaaccgaaaaccgggttaacgtggtacggtaccgtaccgaccgttaacctacgtaccgtttcggttaccttaccggtacttccccgttaccccggtactaccgttcgtaaaccgg

SEQ ID NO: 169771 - DNA, 554 bp, Homo sapiens
  misc_feature: GYAE6OF02IIGQV.37.11.A11.1.454.CMB.1.raw
  modified_base (161)..(161): a, c, t, g, unknown or other
  misc_feature (161)..(161): n is a, c, g, or t
  modified_base (222)..(222): a, c, t, g, unknown or other
  misc_feature (222)..(222): n is a, c, g, or t
  modified_base (373)..(373): a, c, t, g, unknown or other
  misc_feature (373)..(373): n is a, c, g, or t
  modified_base (518)..(518): a, c, t, g, unknown or other
  misc_feature (518)..(518): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctntgggcgagagggcctccatcaactgcaagtccagccagacttgtttatacagctaccaaanaataagaactacttagcttggtatcagcaagaaaccagggcagcctactaaactgctcatttactgggcatccgtaccggggagtccggggtcctgacgattcagtggcaggtcgggtctaggacagtacttcactctacaccatacaacngcctgcaggtctaggaggatggtgtactagtttatactgtacagtactagttaattataacttacctccgtccgtaccgttacggaccgaaaggggacctaagggtacgaaatacgaaacgtacgtgtacggctagcctaaccgntaccgttatccttacacttccctcccgactatctag

SEQ ID NO: 169772 - DNA, 563 bp, Homo sapiens
  misc_feature: GYAE6OF02FZRZK.37.11.A11.1.454.CMB.1.raw
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctcctaaactgctcatttactgggcatccgtacccggggagtcccggggtccctgaccgattcaggtggcaggcgggtctgggacagtattcactcacaccatcaacacgcctgcaggctgaggatggtggcgtatttactactgtcagtcagttattataaattacctcctaccggtacgttcggaccgtaaacgggaccaaggggtacgaaaactacgaaaacgtacgtggtacggctacggacctacctatccgttcgttccttactcttacccgttcccgacctactcgttaacg

SEQ ID NO: 169773 - DNA, 579 bp, Homo sapiens
  misc_feature: GYAE6OF02HPB4F.37.11.A11.1.454.CMB.1.raw
  modified_base (209)..(209): a, c, t, g, unknown or other
  misc_feature (209)..(209): n is a, c, g, or t
  modified_base (292)..(292): a, c, t, g, unknown or other
  misc_feature (292)..(292): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaaacaaataacgaactacttagcttggtatcagcaagaaaccaggacagcctactaaaactgctacatttacgnggcatctacccgggagtccggggtcctgacgatcagtcgcaggcgggtcgtggacagtactttcactctacacatcaacncncctgcaggctagaggatgtggacgtaatttatactgtacagactaagtaattaataactaccttccgttaccgtacgttacggaccgaaagggaaccaagggtaactaaacgtacgaaaacgtacgtaggtacgtcgtacggtaaccaacctataccgttgttaccttactacttaccggtttcccaccgttacttacgtaaccg

SEQ ID NO: 169774 - DNA, 701 bp, Homo sapiens
  misc_feature: GYAE6OF02HQV1O.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcagtccagccagacttgttttanacagctaccaaacaaataacgaactacttagcttggtatcagacaagaaaccgagggacagccctacctaaactgcttacaactttacgcggactacgtaccggtacccggggacggttcccggggtacccctacggaccgtacttcgaggtacggcgacgggtcgggtcgtcgggaactaggtacttcactcctactaaccactaccaactaccgcctcgacgtaacggtctagggaacgtagtggtacgggtacgttaattttaacgttccgtaggtacctaaggtacttaagttactttaaacgaactttacctaccccgttacgggtaaccggtttacccgggaaccgaaaggggtacccgttaaagggttaaccggtaaaactacgaaaaccggttacgtagggtacgtacgttacggaccttaacccgtattccgttacgttccctttacacccggtttcccttaccccggattaccttgttaaccg

SEQ ID NO: 169775 - DNA, 559 bp, Homo sapiens
  misc_feature: GYAE6OF02F3DDS.37.11.A11.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctgggcgagagggcctccatcaactgcaagtccagccagactgttttanacagctcaanaataagaactacttagcttggatcagcagaaaccagggcagcctacctaaacgtgctactatttacgtgggcatcgtacccgggtagtccggggtcctggaccgattccaggtggcaggcgggtctggacagtatttcacttctacaccatacgaacagcctgcgtaggctagacggatggtggacgtattttatacgtgtcagctagtattataactctcctcgtacgtcgacgaacggacctaaggtcgaaactacgaaacgacgtgtacggtctacggtaccacgtactccttacgttaccttacgacgtttccctacccggacctacgttactacg

SEQ ID NO: 169776 - DNA, 627 bp, Homo sapiens
  misc_feature: GYAE6OF02IWNQT.37.11.A11.1.454.CMB.1.raw
  modified_base (209)..(209): a, c, t, g, unknown or other
  misc_feature (209)..(209): n is a, c, g, or t
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaacaaaataagaactacttagcttggtatcagacaagaaaccagggcacgcctacctaaactgactctaatttacgtgggactactccgtacccgggacggtcccggggtccctgaccgtattcagtggcaggcgggtntgggacagtacttcactctcaccatcaacngcctgcaggctggagacgttggtaggcgttaatttagttactagtcgagtactaagttattaataacttacctaccgtccgtacgttaccgggaccgtaaacggggaacccgtaagggtaacgtaaaacgtaaccgaaaaccgtacgttacggtacggtacctacggacctaacccgtattaccgttacgtttaccttaccgtaactttacccgtttccccgaccgttacttccgtaacg

SEQ ID NO: 169777 - DNA, 726 bp, Homo sapiens
  misc_feature: GYAE6OF02HMDTR.37.11.A11.1.454.CMB.1.raw
  modified_base (211)..(211): a, c, t, g, unknown or other
  misc_feature (211)..(211): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgaggagggcctccatccaactgcaagtccagccagacttgttttanacagctaccaaacaataagaactacttagcttggtatcagacaagaaaccgaggcagcctacctaaactcgctctattacgtgggactactccgtacccgggacggtcccgggtcctcggaccgtactcgagtcggacacggtcggtcgtggactagtatttccaccgttctaccacctaactaccaaacgtacgtccgtacgaccgtagggtccttagggaacggttaacgttcgggtacgggtaacgtttaagtttttaacgttaaccgttacggttacgtaacggttaacgttaagtttaattttaaacgttaaacgtttacccttacccgttacccgggtaccgggtttacccggaaccggtaaacgggaacccggtaagggttaacgaaaaccgttaaacgaaaaccggtaacgttcgggttacggtccgtacggaacccgtacctaacgtccgttacgttacctacccgttacgttaccccgttaccccgtacttaccgttccgtaacg

SEQ ID NO: 169778 - DNA, 596 bp, Homo sapiens
  misc_feature: GYAE6OF02IUQRQ.37.11.A11.1.454.CMB.1.raw
  modified_base (208)..(208): a, c, t, g, unknown or other
  misc_feature (208)..(208): n is a, c, g, or t
  modified_base (545)..(545): a, c, t, g, unknown or other
  misc_feature (545)..(545): n is a, c, g, or t
  modified_base (565)..(565): a, c, t, g, unknown or other
  misc_feature (565)..(565): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaacttacttagcttaggtatcagcaagaaaccagggcagcctacctaaactgactcatttactgggcagtccgtaccccgggagtccggggtcccctggaccgattcgagtcggcaggcgggtctgggacagtattcactcacacctataccaacagtcctgcgaggctaggaggtatggtggcgttaattttattacttgtacagtactagttaattactaacttcctccgtccgtaacggttccggaaccgaagggtacccgaagggtacgtaaaacgtacgaaacgtaactggtacgtacgtccggaccaaccgtntttaccgtcgtttccttacncgttacccttacccgaccctattacctaacg

SEQ ID NO: 169779 - DNA, 785 bp, Homo sapiens
  misc_feature: GYAE6OF02HWF69.37.11.A11.1.454.CMB.1.raw
  modified_base (127)..(127): a, c, t, g, unknown or other
  misc_feature (127)..(127): n is a, c, g, or t
  modified_base (163)..(163): a, c, t, g, unknown or other
  misc_feature (163)..(163): n is a, c, g, or t
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
tcagtagtgtagatcacgaccggtgctcgatttagctacgactgcagggcagcaagatggtgttgcagacccaggtcttcatttctctgttgctctggatctctggtgccctagggcgaccgtgatnacccagtctccacgactccctgcgtgtgtctctggngagaggcctccatcaactagcaacgtaccacgccaacgacttagtttttataacagacctccaaacaataaacgaactactttaancgttaggtatacagacacgaaaaccgagggacnccgaccttacctaaaaccgtgccttactaatttacgtagggtcctaacgttacccgtaaccggggtacgttcccggggtacccttacgacccggtacttacgtaggtcggcgacggtgggtacgtacggaacgtagtaactttccaccgttcgtacaaaccgtactaccgtaaaccacggacccttgggaccgtaacggtcgtacgacggtacgtaggtcgggtacgtttacgtttaacgttaactggttaccgacgtacttaagttaacgttaaattaacgttaacctcccgttacggtaccgttaccgggtaaccgtaaaccggggaaacgtaacggtaacgggtaaaaccgtaaacgtaaaacggttaaccgtacggttaggtaccggttaacgtaaccctaacccggttaccttaacgttttacccgttacgtttacccggttaccctttaccccgttaaacccccggttacccctaacccgtttcccgttaaaaccgg

SEQ ID NO: 169780 - DNA, 781 bp, Homo sapiens
  misc_feature: GYAE6OF02HURUU.37.11.A11.1.454.CMB.1.raw
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
  modified_base (367)..(367): a, c, t, g, unknown or other
  misc_feature (367)..(367): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagaggcctcatcactgcaagtccagccagtacttgtttttanacacgcctaccaaagaataacgaacttacttagtcttggtactcagacaagaaaccgnggtacacgcctacctaactgcttactatttacgtgggacctacgttccggtacccggggtacggtccccgggttaccgtaccgaaccgtactttaccggnggttcgggacgtacgggcgggttcgtacggggtactacgttactttcaccgttcgtacccaaccgtataacccaaacgtcgccccgttaggaccgaggggtccgtaggggtaacggtaggtttacgggtcggtacgttttaacgttttaaccttacggttaccgttacgaaccggttcggttaaagttaaccgttttaaacttaaccgtttaccccgtcccggttaacccggttaacgggttaccggaacccgggtaaaacggggaccggttaaagggtaacgggtaaaactaccggtaaaaaccggttcgtaaccgggtacggttaccgtaccggtaacctaccgttacgttaccggtttctaaccgtttcttacccggttacccgttaccccgactttaccgtaccttaacg

SEQ ID NO: 169781 - DNA, 618 bp, Homo sapiens
  misc_feature: GYAE6OF02JF2X9.37.11.A11.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (281)..(281): a, c, t, g, unknown or other
  misc_feature (281)..(281): n is a, c, g, or t
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtggcgagagggcctccatcaactgcaagtccagccagactgtttanacngctccaacaatagaactacttancttaggatcagcagaaaccagggcagcctctaaactgctctatttacngggacatccgtacccggaggttcccgggtcctaggacctagttccaggtggcctaggtcgggtctaggacacggtatttccgacttcctaccgaacctactaccgaaacgcgtcccgtaggcaggtacctacggaggtagtggtgaccggtattttacgttacngtctacggctaagttattaanaactttacaccgtcgtacgttccggaccaaagggtacctaagggtacggtaaacaccgaaacgtacgttcgagggtcctacggaccgaacctacgttccgtacggtttaccttaccgaactttccccgttacccacgttcctacgttaaccg

SEQ ID NO: 169782 - DNA, 735 bp, Homo sapiens
  misc_feature: GYAE6OF02H2LK1.37.11.A11.1.454.CMB.1.raw
  modified_base (212)..(212): a, c, t, g, unknown or other
  misc_feature (212)..(212): n is a, c, g, or t
  modified_base (308)..(308): a, c, t, g, unknown or other
  misc_feature (308)..(308): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttanacagcctacaacaataagaacttacttagcttaggtactcgagacaaggaaaccgagggaccacgtccctaacctaaactgctactaattttacgngggtctacgttccgtacccggggaggttcccggggtccctggacccgtatttccgaggtcggacgtagggccgggtcgtacgggactaggttactttccgaccttctaccaacctactaaccgaaacctcggtcccttaggacgacgggtcgtagggacggtattggggtcggtacgttaactttttacgttaacgttcggtacaacggttaccttaaaggtttaaactttaagttaaaccttaccgtttaccccggttacccggttaccgggtttacccgggaccgtaaaacgggggtaaccctaaaggggttaacgtaaaaacgtccgtaaaaacggtcgttaggtacgggtaccgtacggacctaaccgtattaccgtagtttaccttcgtacctttcccgtacccgtaccttagtacctaacg

SEQ ID NO: 169783 - DNA, 621 bp, Homo sapiens
  misc_feature: GYAE6OF02G270A.37.11.A11.1.454.CMB.1.raw
  modified_base (212)..(212): a, c, t, g, unknown or other
  misc_feature (212)..(212): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgaggagggcctccaatccaactgcaagtccagccagacttgttttanacagctaccaaacaataagaactacttagctttggatcagcagaaaccaggggcagtacctctaaactgctcatttacngggcatcgtacccgggngtcccggggtacctgaccgattcgagtggcnggcggtctgggacagtatttcactctacaccatcaacncgctgcaggntacgaggtagtggtggtacgtaaattttagttaacgttggtacaaggtacctaagtttaatttaaattaacgttaaccttcccgttaccggaaccggtttccggaccgtaaacggggtacccgtaagggttacggaaaacttccgaaaaccggtacgtaggtaggacctcggacctaccgagttaccgttcgttccgttactacgttcccttaccccgcctaagtccttaacgg

SEQ ID NO: 169784 - DNA, 611 bp, Homo sapiens
  misc_feature: GYAE6OF02IR65G.37.11.A11.1.454.CMB.1.raw
  modified_base (207)..(207): a, c, t, g, unknown or other
  misc_feature (207)..(207): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagacttgtttanacagctaccaaacaataacgaactacttagcttggtatcagcaagaaaccagggcacgcctacctaaactgctctactttacgtgggctatccgtaccggggtacgtccgggtcctcgacgtnttcgagtggcnggtcggtcgtggcagtattcactcncacntaccaacncgccncgaacggcgtacgaggtagtcgtggtactagtttactacgtgtacgagtacaagtttaattactaagttaaccctccgtaccgttacggttccggaacgtaacgggaacgttaagggacgtaaaacgtaccgaaaagtaaaccgttgtcgggtacctacgaccgtaactaccgtcgttacttccgtttaccacgttcccgttacccgactacctaccgttagtaaacc

SEQ ID NO: 169785 - DNA, 638 bp, Homo sapiens
  misc_feature: GYAE6OF02I0U1C.37.11.A11.1.454.CMB.1.raw
  modified_base (383)..(383): a, c, t, g, unknown or other
  misc_feature (383)..(383): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttaggtatcagcaagaaaccaggcagcctacctaaactgactatatttacgtggcatccgtacccgggaggtcccgggtcctcgaccgtattcgagtggcaggccgggtctgggactagtactttcacgttctcaccatcaaacncgcctgcagggtctaggacggtatggtaggtacgttaattttacttacgtacgtactaggtacgtaagttaacttaataaaccttccgtacccgtacccggttaaccggttccggaacccggtaaagggaacccgtaagggtacggtaaaactaaccgaaaaccgtacgtgggtacgacttacgacccgtaacctagttaccgtcgtttaccttacccgtaattccccgttccccgtacctactttacgtaaccg

SEQ ID NO: 169786 - DNA, 517 bp, Homo sapiens
  misc_feature: GYAE6OF02HZEKT.37.11.A11.1.454.CMB.1.raw
  modified_base (209)..(209): a, c, t, g, unknown or other
  misc_feature (209)..(209): n is a, c, g, or t
  modified_base (285)..(285): a, c, t, g, unknown or other
  misc_feature (285)..(285): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (508)..(508): a, c, t, g, unknown or other
  misc_feature (508)..(508): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttttanacagctaccaacaataaagaactacttagcttggtatcagcagaaaccagggcagcctacaaactgctcatttacngggcatcgtacccgggagtcccgggtccctgaccgattcagtggcaggcgggtctgggacagtatttcactctcaccatcaacngcctgcaggctgagntgtaggcgtatttatactgtcagtctagttattataatactcctacgacgttcgaccgaagggaccaaggtacgaaactacgaaacgactgtcgactgcaccatctgtcttcacttcctacccnctatctacg

SEQ ID NO: 169787 - DNA, 776 bp, Homo sapiens
  misc_feature: GYAE6OF02IJKOP.37.11.A11.1.454.CMB.1.raw
  modified_base (217)..(217): a, c, t, g, unknown or other
  misc_feature (217)..(217): n is a, c, g, or t
  modified_base (326)..(326): a, c, t, g, unknown or other
  misc_feature (326)..(326): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggccctccatcaactgacaacgtccagccagtacttgtttttaanacagtcctaccaaaactaaataaacgtaacttacttaagtcgtttaggtatacaagacaagaaaccgagggccacgccctacctaaactcgacttactaattttaccgngggtacctacgttacccgggtaacccggggtacggttccccggggtaccctacggaacccgtattcgaggttcggaccgtagggtccgggtcgtagggactagtactttcgacttctacaacctataccaacgacgtcccgtgacgtacggtcgtaggtagggtacgttgggtacggtaacgtttaaacttttagttaacgtcgtacgtaacgtacgtttaagttaaactttaaacttaacttacccgtacccgttaacccgggtaaccggtttacccgggaaacccgggtaaaccgggtaaccggtaaagggttaaaccggtaaaacgttaaccggaaaaacccggttacgtacggtacggtaccgtaccggtaacctaacccgtgttaccgttacgttaccctttcgtaacccgtttccccgttacccgacttacgtaccgttaaccg

SEQ ID NO: 169788 - DNA, 606 bp, Homo sapiens
  misc_feature: GYAE6OF02GKHMY.37.11.A11.1.454.CMB.1.raw
  modified_base (297)..(297): a, c, t, g, unknown or other
  misc_feature (297)..(297): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagcctaccaaacaaataacgaacttacttagctttggtatcagacaagaaaccagggcacgcctacctaaactgctctatttacgngggcactccgtacccgggacggtcccggggtcctagaccgtattcgaggtcggcgaggcgggtcgtagggactagtactttcactctcaccataccaacacgcctgacgaggtctaggaggtagtggtacggtacttattttacgttacgtgtacagtactagttaattaataactccttccgtacgtacggttccggaccgtaacgggaaccgtaaggtaacgtaaactacgaaaacgtacgtaggtacgctacgcctactacgttctacgttacttactacttcccgttccccgactacgtctaacg

SEQ ID NO: 169789 - DNA, 598 bp, Homo sapiens
  misc_feature: GYAE6OF02HUXRX.37.11.A11.1.454.CMB.1.raw
  modified_base (209)..(209): a, c, t, g, unknown or other
  misc_feature (209)..(209): n is a, c, g, or t
  modified_base (256)..(256): a, c, t, g, unknown or other
  misc_feature (256)..(256): n is a, c, g, or t
  modified_base (377)..(377): a, c, t, g, unknown or other
  misc_feature (377)..(377): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaacaataagaactactagcttggtatcagcagaaaccngggcagcctactaaactgctctatttactggcattcgacccgggaggtcccgggtacctgaccgtattcaggtgacgagcgggtctcggacagtactttcgactctccacctataccaacncgtcctgcgaggctgaggtagtcggtggacgttattttacgttctaggtacagtactagttattaataacttaccttacccgtcgtaccgttccggaccgtaagggtaaccgaagggttacgaaaacgtaccgaaaacgtaaccgttggtacggactacggacctaaccgacttcgttagttccttaccactttcccgttaccccgacttaccttctaacg

SEQ ID NO: 169790 - DNA, 609 bp, Homo sapiens
  misc_feature: GYAE6OF02HSTC3.37.11.A11.1.454.CMB.1.raw
  modified_base (328)..(328): a, c, t, g, unknown or other
  misc_feature (328)..(328): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcagtccagccagactgttttatacagctccaacaataagaactacttagcttggtatcagcagaaaccagggcagcctacctaaactgctcatttactggcatcgtacccgggagtcccgggtcctgaccgtattcagtggcnggcgggtctggacagtattcactctacacatacaacagcctgacgaggcgtaggaggtatggtacggcgttaatttagttacgtgtactaaggttagtttaattaagttaactaccgttcccgtaccggtacggttaccggaacccgaaaggggtaaccgtaaaggggtacgaaaacgttaccgaaaacggtaacgttggtacggacgttacgaccgtaacgtacttcgtcgttaccttacgtaccgttcccgttaccccgacctaattccgttagtaacc

SEQ ID NO: 169791 - DNA, 571 bp, Homo sapiens
  misc_feature: GYAE6OF02G8D7Y.37.11.A11.1.454.CMB.1.raw
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaacttacttagcttggtatcagcagaaaccagggcagcctacctaaactgctctatttacngggcatccgtaccccggggagttcccggggtccctggaccgtattcgagtggcaggcgggtctgggacagtatttcactctcactancaacngcctgcaggctaggagatggtggctatttatactgtacagtctaagttattaataactacctcccgtaccgtacggttaccggaccgaaaggggacccgtaaggtacggtaaactacgaaaacgtacgtggtcggtactaggccacgtatccttgttaccttcgtacgttaccgttcccgacttataccgtag

SEQ ID NO: 169792 - DNA, 581 bp, Homo sapiens
  misc_feature: GYAE6OF02GMHLT.37.11.A11.1.454.CMB.1.raw
  modified_base (248)..(248): a, c, t, g, unknown or other
  misc_feature (248)..(248): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctccaaacaataagaactacttagcttggtatcancagaaaccagggcagccctacctaaactgctctaatttactgggcagtccgtaccccggggaggtcccggggtccctggaccgtattcaggtggcgaggccgggtctgggacagtattccacttctacaccataccaacacgcctgcaggctaggaggtatggtagggtacttattttagttacgtgtcagtctagttattaataactacctccgtaccgtacgttaccggacgaacgggtaaccgtaagggtaacgaaactacgaaacgtacgtggtacggctacgctaccgtctcgttcttctactactcccttcccgacttactctaacg

SEQ ID NO: 169793 - DNA, 806 bp, Homo sapiens
  misc_feature: GYAE6OF02GJ3CP.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaaacaataagaactacttagcttggtactacagacaagaaaccgagggcacgtacccttacctaaaactcggaccttacctaagttttaccggtacggggtacctaaccgttacccggtaaccccggggggtaccggttaccccggggggttccccttacgggaaccccgtacgttaccgtacgggtacgggaccgtaacggggtccggggttcgtacggggtaacctaacgggttactttaccgtaacctttacccgtaccaaccctaactaccctaaacgaacccggtccgttacggaccgtaacgggtcgttaagggaacgggtagttacgggttacgggtaccgttaatttttaacgttaacggttacggtaccgtagtaaccgttaagtttaaacgtttaacttaaacgttaccgttcccgtaacccgggttaccggttacccgggtaacccgaaacgggggtaaccgtaaaggggtaacggtaaactaaacggaaaaccgtaaggttcgtacggtctacgtaccaactactccgttacgttaccttacgtaccttacccgttaccccgactacgttcctaacg

SEQ ID NO: 169794 - DNA, 793 bp, Homo sapiens
  misc_feature: GYAE6OF02HXXN8.37.11.A11.1.454.CMB.1.raw
  modified_base (207)..(207): a, c, t, g, unknown or other
  misc_feature (207)..(207): n is a, c, g, or t
  modified_base (255)..(255): a, c, t, g, unknown or other
  misc_feature (255)..(255): n is a, c, g, or t
tcagtagtgtagatcacgaccggtgctcgatttagctacgactgcaggggcgagcaagatggtgttgcagacccaggtcttcatttctctgttgctctggatctctggtgcctacggggacaccgtgatgacccagtctccagactccctggctgtgtctctgggcagaggcctcatcaactgcaagtccagccagacttgttttanacagctacaacaataagaactacttagcttggtatcagcagaaaaccngggcagcctacctaaactgactctaatttacgtgggacacttccgtaccgggacgtcccgggtcctggaccgtattcgaggttggacaggccggttcgtcgggacgtaagtacgttttcaccgtcttacaaccgtatacccaaacgcgtacccgttacggccgtaaacgggtccgttagggtaacgggtacgttaacggggttacgggtaccggtttaaatttttaacgtttacgtcggttaacgaacgttaccgttaaagttaaacgttttaaacttaaacttaccccgttaacccgtttacccggtaaacccgggttttaccgggaaaccccgggtaaacggggtaaaccccggttaaaggggttaaccggtaaaaacgtttaacccggaaaaacccggttaacggttacggttacgggacccgtaacggtaacccttaaacccggtaattttcccggtaaccgttttaccgttacccgttaaccgtttccccgttaacccccggttaacccgtaccgttttacccgttaaaccgg

SEQ ID NO: 169795 - DNA, 534 bp, Homo sapiens
  misc_feature: GYAE6OF02F4I7D.37.11.A11.1.454.CMB.1.raw
  modified_base (346)..(346): a, c, t, g, unknown or other
  misc_feature (346)..(346): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaaacaataagaactacttagcttggtatcagcagaaaccaggcagcctacctaaactgctcatttattgggcatctacccgggagtccggggtccctgaccgattcagtggcaggcggtcgtggacagtntttcactctcaccatcaacagcctgcagctagaggatgtggctatttattactgtcagtcagttattaataactacctccgtcgtacggttaccggaccgaacgggaccaagggtagaaactccgaaaacgactgtaggctaggccaacctatctcgttcttccacttcccttccccgcctatctacg

SEQ ID NO: 169796 - DNA, 699 bp, Homo sapiens
  misc_feature: GYAE6OF02GQR41.37.11.A11.1.454.CMB.1.raw
  modified_base (310)..(310): a, c, t, g, unknown or other
  misc_feature (310)..(310): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggagggcctccatacaactgacaagtccagccagtacttgttttatacagcctaccaaacaaataagaactacttagtcttaggtatacagacaacgaaaaccgagggacaacgcctacctaaactgactactaatttacgngggacacgtaccggtacccggggacggttacccggggtcctacgaccgtacttacgaggtggacacgggtcgggtcgtaggactagtacttcactctacacactacaacacgcctacgcgaacggcgtaggaacggtagtggtacgggtaccttaaagttttacgtaacgtcggtacgtaatacggttaatttaattaaacgttaaattcccttacccgttaccggtaacggttacccgggaccggtaaaacggggacccgttaaaagggtaacggtaaaaccaaaccgtaaaaaccgagttacggttcgggacctacggtaacctaacctagttaccgttacgtccttactacctttaccccgtcccgaacgttacctagttaacccg

SEQ ID NO: 169797 - DNA, 837 bp, Homo sapiens
  misc_feature: GYAE6OF02HQCGB.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttaanacagctccaaacaataaagaactacttagcttggtatcagacagaaaccagggcacgcctactaaactgctactaactttacgtcgggactagttaccgtaaccccgggggacggttcccggggtacccctcggaacccgtacttaccgaaggttcgggaccgtaacgggccggggttacgttacggggactaaaggtaacgttttaccaacctttacctaccgaaccctaatacccaaaaccgtacggacccttagggaccgtacggggtaccttaggaaacgggtaagttcgggttacggggtacttaaagtttttaacgttaccgtaggttaccgaaaggtaaccgttaagtttaaacgttttaaacgttaaacgtttaccctttacccggttaacccggttaaacccgggtttaccgggaaacccggtaaaacgggggtaaacccgttaaaaggggtaacggtaaaaaccgttaaaccggaaaaaaccggttaaccggttcggggttaacgtaccggttaaccggtaacccgtaacccgttaaacgtttcccggttaacgtttacccgtttaacgtaaccctttaccccggttacccccgtacctttacgttaccgttaaacg

SEQ ID NO: 169798 - DNA, 888 bp, Homo sapiens
  misc_feature: GYAE6OF02FLBS9.37.11.A11.1.454.CMB.1.raw
tcagtagtgtagatcacgaccggtgctcgatttagctacgactgcagggggctagacaagagtgtgttgtcagacccaggtcttcgactttcctctgttgctctggatctcgtggtgcctacgggactaccggtggatgacccagtccgtccagtactcccgtggactagtgtctcgtggagagagggcctaccatacaactgacaacgtccagccagtacttcgtttactacacgcctacctaacaataacgacttactagtcgttaggtactcgacgcaacgaacgacgggccacggtaccctacccgtaaacgtcgtacctactactttaccgtacgggccgtacgttaccggtaaccccggggtacggttacccggggtcccctacggacccgtaacgttccgacggtcggaccgtacgggtccgggtcgtaccgggtacaaccggttaactttccgaacggtccctaccgaaaccgttacgttaccgaaaccgtacggtccccttacggtaacccggtacggtaacccgtagggtaacggttaaccgtgggttaaacggggtaccttaaaccggtttttaaacctaacccggttcgtacccgtaacgttacgtttaaacgggtttaatttaacccgtaaactttaaccccgtaccccgttaacccgggttacccggttaacccgggtaccccggtaaacgggtaacccggtaaaccgggttaagttaaaacccggttacccgtaaaaacggttaccccggtaggtaacccgggtcccgttaaccgtacccgtaaaccccggtagtttacccggtacccttttacccggtaccctttacccgtaccccgttttaccccggaccgttacggtaccccttaaccgg

SEQ ID NO: 169799 - DNA, 564 bp, Homo sapiens
  misc_feature: GYAE6OF02GOBMY.37.11.A11.1.454.CMB.1.raw
  modified_base (281)..(281): a, c, t, g, unknown or other
  misc_feature (281)..(281): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaccagggcagcctctaaactgctcattacngggcatcgtacccgggagtccgggtcctgaccgatcagtggcaggcgggtctggacagtactttcgactctcaccatcaacngcctgcaggctgagngtgtggctatttatactgtcagtcagttatataactctcctcgtacgtcggaccgaagggtacccaaggtacgaaactacgaaaacgtaccgtagtacggtaccgtaggacccaacctacgttaccttacggtttaccttacctaacgtttccccgttaccccggaccttaccgttaccgtaaccg

SEQ ID NO: 169800 - DNA, 731 bp, Homo sapiens
  misc_feature: GYAE6OF02HUS1S.37.11.A11.1.454.CMB.1.raw
  modified_base (216)..(216): a, c, t, g, unknown or other
  misc_feature (216)..(216): n is a, c, g, or t
  modified_base (328)..(328): a, c, t, g, unknown or other
  misc_feature (328)..(328): n is a, c, g, or t
  modified_base (412)..(412): a, c, t, g, unknown or other
  misc_feature (412)..(412): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggagggcctccatcaactgcaacgtccagccagtacttagttttanacagtcctaccaaacaaataaacgaacttacttacgtcttaggtactacgagaccaaacgaaaaccgaggggccacgcccttaacctaaaactcgaccttactaatttacgngggactacgtccggtaacccggggacggttcccgggtcctggacccgtattcgaaggtcggacacgggtcgggtacgacggganaggttacttccacctctacacctatcagaccgacgtccgtgggccgggtactacgggaagtacggttcggttacgggttcggttttacttacggtcgtacgacgtacgttaagtttaactttagtttaccgttaaccttccgtaacgtaacgttttacgggtttaccgggaacccggtacgggggtaaacctaaggtcgtagggtactacgtccggtaaccgaacgttaacggttcgggtaccgggtcctacggtaccctaaccttgtttaccgttaccggttccttaccgttaaccccttcccgttaccccgtacccg

SEQ ID NO: 169801 - DNA, 721 bp, Homo sapiens
  misc_feature: GYAE6OF02H4LJU.37.11.A11.1.454.CMB.1.raw
  modified_base (315)..(315): a, c, t, g, unknown or other
  misc_feature (315)..(315): n is a, c, g, or t
tcagtagtgtagatcacgaccggtgctcgatttagctacgactgcagggggtcgagcaagactggtcgttgcagacccaggtcttcatttctctgttgctctggatctactggtgcctacggggacacccgtgatgacccagtctccagactccctgtcttgtgtcttacgtgggtcgagtagggcctaccgatcaactgcaagtccagccgagacttgttttatacacgctaccaacaataagaactacttagcttaggtatcagctacgaaaccgaggacacgtcctacctaaactgtacttctaactttacncgggacacgttaccggtacccgggtacggttaccccggggtccctacggtaaccggtactttcgagggtcggcgtacggtcgggtcgtacggtacgtagtatttcactctacactatacaactacgccgtgacgaggctaggacggtattggcgtagttaactttactagtacggtacaacgtacgttaaagttaactttaactaacgttcctacccggttaccggtaacggtttaccgaaccggaaacggggtaaccgtaaacgggtttacggaaaaactacccgaaaaacgggtaccgttagggccggttactccggtaaccctaaaccttgttacccgtttacgttaccgtttaaccgtacgtttacccccgtttccccggaacttacgtacccgttaaacgg

SEQ ID NO: 169802 - DNA, 632 bp, Homo sapiens
  misc_feature: GYAE6OF02IDIAB.37.11.A11.1.454.CMB.1.raw
  modified_base (212)..(212): a, c, t, g, unknown or other
  misc_feature (212)..(212): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (333)..(333): a, c, t, g, unknown or other
  misc_feature (333)..(333): n is a, c, g, or t
  modified_base (574)..(574): a, c, t, g, unknown or other
  misc_feature (574)..(574): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggagggcctcatcaactgacaagtccagccagacttgtttanacagctacaacaaataagaaccttagttagcttaggatcagaccaagaaaccgaggcagcctaccgtaaangctntatttacgcggctagtccgtaccgggacgttccggcctggaacctntcgagtcggactaggtccggtgtacggactaggactttcacgtttcgacctacactaacacgacggtcctgccgtaaggtctagggaacggtagttcgacggtacgttaatttacggtatggtaccagttactaaggtattactactacgcccgttagtaccggttcgaaccgaacgggtactaacggggttaagaaacctagaaaccggtagttgtaccgggcttcggaacccttaaccngttcgtaccgtttacctacggtaccttaccccgggtacccctcgttactcccgtaaag

SEQ ID NO: 169803 - DNA, 582 bp, Homo sapiens
  misc_feature: GYAE6OF02FP9VD.37.11.A11.1.454.CMB.1.raw
tcagtagtgtagatcacgaccggtgctcgatttagctacgactgcagggggtcgagcaagatggtgttgcagacccaggtcttcatttctctgttcgctctggatctcgtggtgcctacggggacaccgtgatgacccagtcctccagactccctggctgtgtctctgggccgagagggcctccatcaactgcaagtccagccagactgttttactacagctaccaacaagtaagaactacttagcttggtatcagctaagtaaaccagggtcagcctactaaactgacctacgattactcgggcagtcgtaccccgggtagtccggggtcctgaccgtattcagtgcagcgtgtgggacagtacttcgactctacaccatcaacagtcctgaccaggctaggaggactgtggtacgatttaagttactgtcagtcagttaattataatccttccacgtacgtttacgaccgaagggtacccaaggttacggaaactacaaaacgaacttggtacggtactaggccaaccgtacgttacgttacggtacttacgacgtttcctacccggactacgtctaacg

SEQ ID NO: 169804 - DNA, 737 bp, Homo sapiens
  misc_feature: GYAE6OF02JT569.37.11.A11.1.454.CMB.1.raw
  modified_base (214)..(214): a, c, t, g, unknown or other
  misc_feature (214)..(214): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggacggcctccatcaactgacaagtccagccagtacttgtttanacgcgcctaccaaactaagtaacgaacttacgttagtcttaggtactcgagacaacgaaaaccgagggaccacgtacccctaccgtaaaactcgtaccttactacgttttaccgtcgggactacgtccggtaacccggggtaccggttcccggggtaccctcggtaacccgtacgttccgaaggttcggcgacggtccgggtcgtacgggactagtactttccgaccttactaccgaactaccgtacaaccgtcgtacccgtcgacggtaggtacgtacggtaggagttcgggtacgtacgttactttaacgttcgtcgacgtagtacgttaacgttatttaacgttaacctccctaccggttaccgtaaccgggtacccggacggtaaccggtaaacggtaagggttaacgaactaaaccgtaaaccgttagttacggtacgtacgtaccggtactaacctaggtaccgttacgttacccgttacttaccgtcccgttacccgaccttacgtaccttaaccg

SEQ ID NO: 169805 - DNA, 565 bp, Homo sapiens
  misc_feature: GYAE6OF02FX914.37.11.A11.1.454.CMB.1.raw
  modified_base (210)..(210): a, c, t, g, unknown or other
  misc_feature (210)..(210): n is a, c, g, or t
  modified_base (388)..(388): a, c, t, g, unknown or other
  misc_feature (388)..(388): n is a, c, g, or t
  modified_base (558)..(558): a, c, t, g, unknown or other
  misc_feature (558)..(558): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagcctaccaaacaataacgaactacttagcttggtatcagcaagaaaccagggcagcctacctaaatgctctatttacgtgggctactccgtaacccggggcggtcccggggtccctggaccgtattcgaggtggcgaggcgggtcgtggacagtattcactctacacatacaacngccgtgcgaggctaggaggtatggtggtacgtattttagtcgtctgacagctaagttaattaatactcctccctacggtacgttccgacgaaaggactaagggtagaaactcgaaacgatcgagtacgtcacacctattcgttctacttcgtaccttcccgtcccgtacngttaccg

SEQ ID NO: 169806 - DNA, 572 bp, Homo sapiens
  misc_feature: GYAE6OF02FZ6NM.37.11.A11.1.454.CMB.1.raw
  modified_base (385)..(385): a, c, t, g, unknown or other
  misc_feature (385)..(385): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcaagaaaccagggcagcctctaaactgctcatttactgggcatccgtaccccggggagtcccggggtccctggaccgattcagtggcagcgggtctgggacagtactttcactctcacatcaacagcctgcaggctagngatgtggactatttattactgtacagtcagttattaactaataccttcctaccgtataacgttccggaccgtaaacgggacctaaagggtacgaaataccgaaaacgtacgttaggtacggcttacgacctacctagttaccgttgttaccttcctaacgttcccttaccccgtcgtacttacccgg

SEQ ID NO: 169807 - DNA, 774 bp, Homo sapiens
  misc_feature: GYAE6OF02JOGTG.37.11.A11.1.454.CMB.1.raw
  modified_base (275)..(275): a, c, t, g, unknown or other
  misc_feature (275)..(275): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaacgtccagccagacttgttttacacagcctaccaaacaaagtaaacgtaacttaacgttagtcgtttaggtaactcagcaagaaaccngggaccagcccttacctaaacgtcgaccttctaacttttacggcgggactaacgttacccggtaaccccggggacggttccccgggggtaccctacgggacccgttacgtttccggaacggttcggaccggacggggtccgggttaacggtacggaaccgtaacggttaactttccaaccgtttctaccgtaacctaactacaaacctcggtacctcgggtaaccgagggtccgtaaggtagtacggttacgggtacggtacggttaaatttttacgtaacggtttcgtacgtaacggttactaaaggtttacttaacgtaacttcccgttaccgtaccggttacgttaccggaccgttaaacgggtaccgtaagggttaacgtaaactaaccggtaaacgtaacgtcggttacgacgtacgacctaacgttcgttaccgtttaggtcccgttttaacaccgtttttcccgtaccccggtacttaactttccgtaaacg

SEQ ID NO: 169808 - DNA, 536 bp, Homo sapiens
  misc_feature: GYAE6OF02HJRR1.37.11.A11.1.454.CMB.1.raw
  modified_base (208)..(208): a, c, t, g, unknown or other
  misc_feature (208)..(208): n is a, c, g, or t
  modified_base (395)..(395): a, c, t, g, unknown or other
  misc_feature (395)..(395): n is a, c, g, or t
  modified_base (487)..(487): a, c, t, g, unknown or other
  misc_feature (487)..(487): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataaagaactacttagcttggtatcagcagaaaccagggcagcctacctaaactgctcatttactgggcactccgtacccgggacgtcccggggtccctggaccgtattcagtggacagcgggtctgggacagatttcactctcacatacgaacagccctgcaggctgaggatgnggctatttattactgtcagtcagtacttaataactacctcctccgtacgttcgaccgaacggaccgtaagtcgaaatcaaaacgtactaggngcgtagccacagtctacgttctacacttcccttcccgactattactacg

SEQ ID NO: 169809 - DNA, 710 bp, Homo sapiens
  misc_feature: GYAE6OF02IHSQQ.37.11.A11.1.454.CMB.1.raw
  modified_base (237)..(237): a, c, t, g, unknown or other
  misc_feature (237)..(237): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (481)..(481): a, c, t, g, unknown or other
  misc_feature (481)..(481): n is a, c, g, or t
  modified_base (509)..(509): a, c, t, g, unknown or other
  misc_feature (509)..(509): n is a, c, g, or t
tcagtagtgtagatcacgaccggtgctcgatttagctacgactgcgtaggggcagcaagatggtgttgcacgacccaggtcttcatttctctgttgctctggattctctgtcgccgtacgggcaccgtgactcgacccagtcgccagacctccgtggctggtcgtctcgtgggccgagacgggccctccgagccgaactgaccgtaacgttccagcccagtaccttgttttaacacncgtactcaaactaagtaacgaacttacttcgnttcggttancacggacaacgaaaccgngggtaccatacccgactaagtgaccttactaagttttcgacggtcctaacggtccggtaacccgggtgttcccgggtaccttaccgaaccggtacttaccggacggtcggtacccgagggtccggttcgaaccgggtataacgtaacgtttacgcgtttaccacgtaacctgttaaccgaacgtntccgtagcgaacggtctaggaacggttntacgggcgttagttacttttacgacgctacggaattacgtaattaagttaccgaatttccgccgttacggttaccggacccgtacgtaaacggtcgttaagaaccggttaactaacggaacgtaccgttggaccgacgttaaccgaccgtaactctaccggttacttcgtacgtcctccggtttacccagtctttggaacc

SEQ ID NO: 169810 - DNA, 737 bp, Homo sapiens
  misc_feature: GYAE6OF02JJ28P.37.11.A11.1.454.CMB.1.raw
  modified_base (210)..(210): a, c, t, g, unknown or other
  misc_feature (210)..(210): n is a, c, g, or t
  modified_base (508)..(508): a, c, t, g, unknown or other
  misc_feature (508)..(508): n is a, c, g, or t
tcagtagtgtagatcacgaccggtgctcgatttagctacgactgcgagggcagcaagatggtgttgcagaccaggtcttcatttctctgttgctctggatctctggtgcctacgggacaccgtgatgacccagtctccagactccctggctgtgtctcgtgggcgagacgggcctccatcaactgcaagtccagccagtacttgttttanacacgctaccaacaataacgaacttacttagcttggtaatccaagcaacgaaaccgacggacacgccctacctaaacgcgtacctactaattttacgagggacacgttccgtaccggggtacgtcccgggtacctcggaaccctagttccgaaggttcggacacggtccgggtcgtagggaactacgttacgtttccaacgtcctaacgacctaacgtcgaaacgacggtccctggaccgaggtacgtcggaaggtagtcggtaggtacgttactttacgtttacgacggtctaacgnggttaacgtttaactaagtaaaccctttacgcccgttaccgggaaccgtttccggggaaaccaaacggggtaacccgttaaaggggtaaccgtaaaaccgtaaacgtaaaacccgggtaacgtcggttacgggtcctaacgggtaacccacgttaaccggtacgttaccgtttaccggttacctaccgggtttaaccccttccccgggtactttacgtaccggttaacg

SEQ ID NO: 169811 - DNA, 780 bp, Homo sapiens
  misc_feature: GYAE6OF02GC16L.37.11.A11.1.454.CMB.1.raw
tcagtagtgtagatcacgaccggtgctcgattagctacgactgcaggggcagcaacgatggtgttgcagacccaggtcttcatttctctgttgctctggatctctggtgcctacggggacaccgtgactgacccagtctccagtactcccctggctgtcgtctcgtcgggcgagacgggcctccatcaactgccaacgtccagcccagtaccttgtttaactaccacgcctcccaacactacgaccttacctacgccttaggtactcgactaccaacgaacccgacgggtccacgacccctacccgtaaactcgaccttcctaactttaccgtcggtacctacttacccggtaaccgggtaccggtccccgggggttacccctacggtaccccgtacgttaccgaacggtcggtccgtaacggtccgggggtttcgacgggtaacctaacgtaccgtttccaaccgtttccctaacgaaccctacgtaacccaaccgtaccggtcccgttacggccctacggggtacctacggtacgggtacttaccggtcgggtaacctttaaacgttttaccgtaaccgttcggtaccgacgttacgtagttttaactaacctacgtacccgttacccgtacgggtaccgttaccggaacccgtaaacgggtaaacccaagggtaaccgaaacttaaacggaaccgtaccgtacggtcgaccttacggccctactacttccgtacgttccctacgaccttccccgtccccgaccgtattccgtaaccg

SEQ ID NO: 169812 - DNA, 781 bp, Homo sapiens
  misc_feature: GYAE6OF02J25RI.37.11.A11.1.454.CMB.1.raw
  modified_base (224)..(224): a, c, t, g, unknown or other
  misc_feature (224)..(224): n is a, c, g, or t
  modified_base (288)..(288): a, c, t, g, unknown or other
  misc_feature (288)..(288): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtcctccagtacctcccgtggctgtcgtctcgtgggcgaggacggcctccatcaactcgactacgccagccagtacttgtttacacncgacctaccaaacaaacgtaacgtaacttactacgtcgttagtactcgacgacaaacgaaccgnggcaccgacctaactaactcgtcctacgtacttacggcggacctacgtaaccggtcccgggtaccgggttccccgggtacctacggtaaccgttacgttacggaacggttcgggaccggtagggtcccgggttacggacggtaaccttacggtttaccttaccctaaccgttcccgtaacctaaacctaccgttaaccgaaccgttacccggtcccgtaggtacccggtaggttcgaacggggtagtcgttcgggtagttaactttagtttacgcgttcgagtaacgttacgtactttaagttaaccctaacgtccccgttacgtaaccgggtccgtaacggtaacccgggaagtaaaccggtagggtaaacaaaccgtacgaaaccggttgacggttacgaccgtttacccgaacgttacctagttcccggttaaccttacccggtttacctacccggtaaccccgttcccaacgttaccggttcttaaacg

SEQ ID NO: 169813 - DNA, 676 bp, Homo sapiens
  misc_feature: GYAE6OF02GZI2Z.37.11.A11.1.454.CMB.1.raw
  modified_base (169)..(169): a, c, t, g, unknown or other
  misc_feature (169)..(169): n is a, c, g, or t
  modified_base (324)..(324): a, c, t, g, unknown or other
  misc_feature (324)..(324): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagngggcctccatcaactgcaagtccagccagacttgttttatacagctccaacaataagaactacttagcttaggtatcagcaagaaaccagggcagcctacctaaactgctcatttactgggcactccgtacccggggagtccgggtcctgaccgnttcgaggtcggcaggtcgggtctgggacagtacgtttccacctctacaccaataccgaaactacggcctaggccgtaaggcttaggaggtaacgtgggtaggtacctttaagttttaaacgttacggtcgttaccgaaggttactaaacggttaattttaaactaacccgttaacgtccccgttaccgggtaaccggtttccgggaaacgtaacgggggtaacccgtaaaggggttaacgtaaaaactaccgtaaaaaccggtagttccgggaggttcctacggaccctaaccttagttcccttggttaaccttcttaccttacccgttccccgaacttacgttcgtaaccg

SEQ ID NO: 169814 - DNA, 560 bp, Homo sapiens
  misc_feature: GYAE6OF02JVWG2.37.11.A11.1.454.CMB.1.raw
  modified_base (169)..(169): a, c, t, g, unknown or other
  misc_feature (169)..(169): n is a, c, g, or t
  modified_base (206)..(206): a, c, t, g, unknown or other
  misc_feature (206)..(206): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagngggcctccatcaactgcaagtcagccagctgttttanacagctaccaacaattaagactacttagcttgatcagcagaaaccaggtnacgcctctaaactnacctntatttacgnggcatcgacccggagtccgggtcctggcctatcagtcgancgnggtcgagctatnttcactcnaccgatacanacgctgcagtcagaggntcggaggacttattacgttactagtacgagtctagttaatataattaccgtccctcggtaccgttacggcccgaacgtaacgtaacgtagggaaacttaacgaacgtaacctggtaggtctaacggctaaccctagcctttggtaccttactacgttcccctccgtttaccgatttaccggtaacg

SEQ ID NO: 169815 - DNA, 548 bp, Homo sapiens
  misc_feature: GYAE6OF02GML26.37.11.A11.1.454.CMB.1.raw
  modified_base (285)..(285): a, c, t, g, unknown or other
  misc_feature (285)..(285): n is a, c, g, or t
  modified_base (370)..(370): a, c, t, g, unknown or other
  misc_feature (370)..(370): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaccagggcagcctacctaaactgctcatttacngggcatcctacccggggagtcccggggtcctggaccgattcgagtggcaggccgggtcggacagatttcactctcaccatcaacngcctgcaggctgaggtatggtggacgtatttatacctgtacagctaagtattataactctcctcgtacgttcggacctaagggaccaaggtcgaaactacgaaaacggacttggtaggccttagcctaactattcctagttccttcgacttccgttacccgctacgttcctagtaacc

SEQ ID NO: 169816 - DNA, 555 bp, Homo sapiens
  misc_feature: GYAE6OF02H2AS7.37.11.A11.1.454.CMB.1.raw
  modified_base (210)..(210): a, c, t, g, unknown or other
  misc_feature (210)..(210): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (386)..(386): a, c, t, g, unknown or other
  misc_feature (386)..(386): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaaacaataagaactacttagcttaggtatcagcaagaaaccagggcagcctactaaactgctctattacnggcatcgtaccgggngtccgggtcctgaccgtattcgagtggcaggcggtcgtggacagtattcactcacacatacaacacgtctgcaggctggagntggtggtcgttatttactctgtacagtctaagttattaattactacctccgttacgtaacggttccggaccgtaaagggaaccgaaggtacgaaactacgaaacgtacgtggtacgctcgactacctagtcgtacgttctacgtcttacccgtcccgactactctaacg

SEQ ID NO: 169817 - DNA, 669 bp, Homo sapiens
  misc_feature: GYAE6OF02HKZIE.37.11.A11.1.454.CMB.1.raw
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgtttttanacagctaccaacaataagaactacttagcttggtatcagacaagaaaccgagggacacgcctacctaaactcgctactatttacgngggacacgtaccgtacccgggaggtcccgggtcctcgaccgtattacgagtggcgaggtcgggtcgtcggacagtacttcactctacaccatcaacagcctagcgagcgtggacggtgtaggtcggtacttaagttttacttacgtagtctaacggtaccgtaagttaactttaacgttaaacttccgtacccgttacccggttaacggttacccgggtaaccgtaaacggggtaaccgtaaaggggttacgtaaaaccgtaacgtaaaaaccgttacggttacggtacggtacgtaccggacctaaccgtagttaccgttacgttaccgtttacctacgttccccgttaccctacgttacgttcctaaacg

SEQ ID NO: 169818 - DNA, 719 bp, Homo sapiens
  misc_feature: GYAE6OF02JKVMD.37.11.A11.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtggcgagaggcctccatcaactgcaagtccagccagcttagtttanacngctaccaactaataagaactcgtagcttagatcagcaacgaaaccgaggacacgtcctacctaaactcgtacctactaacgtttacgtacgggactaacgttacccggtaccccggggacggttccccggggtaccctacggtacccgttacgtttaccggaggttcgggaccgtacggggtaccgggtcggttacgggaacctacggttaacgtttccaccggttctaccgaacctataccgaaacgtcgtacccgtgacgtacgggtctaggtacggtagttcggtcggtacgttaatttacgttaagtcgtacacgtactagttaacttactaaaccgttccgtacccgttacggtacccggttaccggtaccgtaagggtaacccgtaagggtaaacgtaacctaaacgtaaaccgaacgtcggtacgacctcggtaacccgtaataccttaccggtacgtttaccttcgtaccttccctaaccccggtcttagttacccttagg

SEQ ID NO: 169819 - DNA, 741 bp, Homo sapiens
  misc_feature: GYAE6OF02H99ZU.37.11.A11.1.454.CMB.1.raw
tcagtagtgtagatcacgaccggtgctcgatttagctacgactgcagggcgagcaagatggtgttgcagacccaggtcttcatttctctgttgctctggatctctggtgccgtacggggacaccgtgatcgacccagtctccagactcccgtggctgtgtctcgtgggcgaggacgggcctccatcaactgcaacgtccagcccagtacttagttttactacgacgtcctaccaaactaaataaacgaacttacttagtcgttggtatcagacaacgaaccgaggcacgcctacctaacgtcgctactagtttactcgggactacgtccggtacccgggacggttcccgggtcccacggacccgtattacgaggttcgacgcgggtcgggttaccggtagggacctaagttactttaccacctttaccgtaccaacccgtataaccccgtaaacgaccggtcccgtacgggtacccgtaacgggtacgtagggttaacgggtacggttacggtcgggtactttaaagttttacgttacgttacgtacgtacgtaacgtttagttaactttaaacgttaacgttaccctacccggttacccgtaaccggtttaccgggaccgtaaacggggaccgtaaagggttaacgtaacgtaacgaaaccgtagtacggtcgtacgtcgtacaccttacgtaccgtttcgttaccttcctaccgttcccgttacccaccttatctaacg

SEQ ID NO: 169820 - DNA, 491 bp, Homo sapiens
  misc_feature: GYAE6OF02GR5SF.37.11.A11.1.454.CMB.1.raw
  modified_base (373)..(373): a, c, t, g, unknown or other
  misc_feature (373)..(373): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcattactgggcatctaccgggagtccggggtcctgaccgattcagtgcagcgggtctggacagattcactctcaccatcaacagctgcaggctgaggntgtggcgtatttatactgtcagcagtattataatctcctcgcgttcgcaagggacaaggtgaaatcaaagactgtagctgcactactctgtcttcacttccttcccgctagtctaacg

SEQ ID NO: 169821 - DNA, 587 bp, Homo sapiens
  misc_feature: GYAE6OF02GBWAE.37.11.A11.1.454.CMB.1.raw
  modified_base (285)..(285): a, c, t, g, unknown or other
  misc_feature (285)..(285): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttatacagctaccaacaataagaactacttagcttggtatcagtcagaaaccagggcagcctcctaaactgctcatttacngggcatcctacccgggagtcccgggtccctgaccgatcagtggcaggcgggtctggacagtattcactctcaccatcaacngcctgcagtctagagntgtggcgtattttactacgtcgtacgagtacgagttaacttataactacctccgtaccgtaccggttccgaccgtaaaggggacccgtaagggtagaaaactccggtaaaagaccgttaggtcggtacgtcggaacctaacccgtacgttccgttacggttccttacgtacgttcccctttccccggacttacgtccttaaccgg

SEQ ID NO: 169822 - DNA, 775 bp, Homo sapiens
  misc_feature: GYAE6OF02J2MKO.37.11.A11.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtcctccagacctccctggctgtgtctcgtggcgagacggcctcatcactgctagtccagcagtacttgtttanacacgcctaccaanaaataacgtaacttacttagtcgttaggtatcgaagaccaaggaaacccgaggggccacgaccccttacctaaacgtcgacctacgttatttacggcgggacaccgttacccggtacccgggaacggttccccgggtaccttacgggaaccgttattaccggtacggtccgggtaccgtacggggccggggtttaccgacggggtaacctaacgggtttactttaccggtaaccctttccctaccctaaaccgtacgttaacccgaaacgtacccggtcccgttaccggacgtaggtacccccccccccccgtaggtacggtaacgttcggtacggtacgttagtttaacgttacgttcgtacgtacgtactacgttaacgtttaacttaacttacctaccgttccgtaccggtaccggtacccgtaacggaaccggtaacggtaacgtaaacgtaacgtaacgtaacgtacgtacggtacgtacgtacctaccgtacttaccgttcgtacgttacgtaccgtcccgttacccgtacctactacgttacg

SEQ ID NO: 169823 - DNA, 645 bp, Homo sapiens
  misc_feature: GYAE6OF02GJ98F.37.11.A11.1.454.CMB.1.raw
  modified_base (289)..(289): a, c, t, g, unknown or other
  misc_feature (289)..(289): n is a, c, g, or t
  modified_base (380)..(380): a, c, t, g, unknown or other
  misc_feature (380)..(380): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttttatacagctccaacaataagaactacttagcttggtatcagcaagaaaccagggcacgcctacctaaactgctcatttacgngggcagtccgtacccgggacggtcccggggtccctgaccgtattcgaggtggcaggcgggtcgtaggacagtattcactctcacatcaacncgcctgcaggctagaggtacgtggtggctattttatacgtgtcagtcgtaagtttattaattaacgtaccttaccgttcccggtaaccggtttccgggaacccgtaaacggggtaacccgtaaaggggttaacggtaaaaactaccggtaaaaaccgtaacgttaggtacgggtactacggtaccctaacccgtaagttcccttacggtttacccttacgtaccgtttccccgttaccccggtaccttaccgttccgttaaaccg

SEQ ID NO: 169824 - DNA, 605 bp, Homo sapiens
  misc_feature: GYAE6OF02G613V.37.11.A11.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (288)..(288): a, c, t, g, unknown or other
  misc_feature (288)..(288): n is a, c, g, or t
  modified_base (396)..(396): a, c, t, g, unknown or other
  misc_feature (396)..(396): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctaccaacaataagaactacttagcttggtatcagcaagaaaccngggcacgcctacctaaactgctctatttacgngggctatccgtacccgggaggtcccggggtcctagaccgtatcgaggtggcgaggcgggtctcgggactaggtactttccgaacttcgtaccacctaataccaaaccncgtccctggaccacgggtctacggaggacgtgtcggggacttaattttacttacgtcgtacagtctaagttattaataactcctcccgtcgtaccgtcgaccgaaagggacctaagggtagtaaacaccgaaacgacttaggcgtactcggacctaaccgtatccgtttacgtaccttccgtacgttcccttacccgactactacgtac

SEQ ID NO: 169825 - DNA, 705 bp, Homo sapiens
  misc_feature: GYAE6OF02GV9HK.37.11.A11.1.454.CMB.1.raw
  modified_base (219)..(219): a, c, t, g, unknown or other
  misc_feature (219)..(219): n is a, c, g, or t
  modified_base (289)..(289): a, c, t, g, unknown or other
  misc_feature (289)..(289): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttatacagctccaanaataagaacttacttagcttggtatcagcaagaaaccagggcacgcctacctaaacgtgctcatttacgngggcatccgtacccgggtaggtcccgggtccctggacccgtagttccaggtcggactacggcgggttcgaggaccagtactttcaaccttctacaccgtataccaaaccgacgccttaggcctacggtcgtaggaacggtattcgggtgggtacgttaattttaacgttacgttcgtactaggtaaccgttaagttttaaactttaagttaaacttacccgttacccgttacccggtaaccggtttaccgggtaacccgaaaggggtaacccgtaaacgggttaacgtaaaacgttacccgaaaaacgggttaaccttggggtacgtccgtaacggtacccgtaacctacgttaccgttggttaccctttacgttaaccttcccgtttaccccggtaccttaggttccttaaccgg

SEQ ID NO: 169826 - DNA, 563 bp, Homo sapiens
  misc_feature: GYAE6OF02HTPF6.37.11.A11.1.454.CMB.1.raw
  modified_base (326)..(326): a, c, t, g, unknown or other
  misc_feature (326)..(326): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttaacagctccaaacaataagaactacttagcttggtatcagcagaaaccagggcacgcctacctaaactgctctatttacctgggcatccgtacccgggagtccggggtccctggaccgnttcgagtcggacaggcggtctgggacagtattcgactctcaccataccaacacgtcctgctaggctaggaaggnttggnggtactaatttatactgtactgactagtaattataatacctcctcgtacgttaccggaccgaacgggacctaagggtacgtaaaactacgaaaacgtacgtggtcgctacgcctaactgtacctgtcttaccacttcccgtcccgaccgtatctaacg

SEQ ID NO: 169827 - DNA, 926 bp, Homo sapiens
  misc_feature: GYAE6OF02GJ9ZF.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactcctggctgtgtctcgtgggcgaggagggcctccatcaactgcaacgtccagccagtacttgttttatacacgcctaccaaacaaataaacgtaacttaacttagtcgtttaggtactcaagacaacgaaaccgagggacacgtcctacctaaaactcgactactaactttacgtgggtacctaacgtcccggtaacccgggggtaccgggttcccgggggtaccccttacggtaacccgtacgtttaccggaggttcgggaccgtacgggtccggggtaccggttacgggggaactaacggttactttaccgtaacctttacccgtaccctaacctaacttaacccgaaaccgtaccgtacccgtacggtaaccgacggggtaccgtagggaaacgggtacgttacgggttacgggttaacgttaacgtttttaaacgtttaccggtacggttaacgtaacggttaccgttaaagtttaacgttttaaacgttaaacctttacccggtttaccccggttaacccggggttaccgggtttacccgggtaaaccccgggtaaaaccggggggtaaacccggttaaaacgggggttaaccgtaaaaaccggttaaaccgtaaaaacccgggttaacggtttacgggttaccgggttaccgttaacccggtaacccgtaaaccctttaacggttccgtttaaccgggtttaccctttacccgtttaacccgtttacccccggtttaccccccggttacttaacccggtttaccggtttaaacccg

SEQ ID NO: 169828 - DNA, 725 bp, Homo sapiens
  misc_feature: GYAE6OF02IFPBQ.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctccaaacaataagaactacttagcttggtatcagacaagaaaccaggcagcctactaaactgactcaatttacgtggacactaccgtacccgggacgttcccgggtcctgaccgtattcgagtcggctaggcgggtctagggacctaggtactttcgaccttcgtaccaaccagttaaccaaactacggcccttaggccgtaacggccgttagggaacgggtacgttcgggtacggtacgttaaagttttttacgttaacgttcggtaccgtaagtaccgtaaaggtttaactttaaacgttaaacttaccgtacccgttaccggtaaccggtttaccgggaacccgtaaaggggtaaccctaaaggggtttaccggaaaaacttaaccggtaaaaccggtaaaccgttggttaccggtaccgttacgaacccgtaaccctaacgtttccgttaccgttaccgtttaccaaaccgtttccccttaccccggacctaccgttaccgttaaccgg

SEQ ID NO: 169829 - DNA, 636 bp, Homo sapiens
  misc_feature: GYAE6OF02H89C0.37.11.A11.1.454.CMB.1.raw
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (461)..(461): a, c, t, g, unknown or other
  misc_feature (461)..(461): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaanaaattaagaactacttagcttaggtatcagcaagaaaccagggcagcctcctaaangctcattttacgnggcattcctaccgggagtccggggtcctaggccgattcgagtcggacgtaggcgggtactagggactaggtacttcgtacttcgtaccaccgactaccaactacggcctggtaccgaggtaccttagggaacggtagtgggtacggtcgttaattttacttacgtcgtanacggtactagttacttataactcctaccgttacgacgttacggaccgaagggtacccgaaggtacgtaaactacggtaaaacgtacgttagtccggacgttacgacctaaccgtacttaccgttacgttacgttcctacttaccccgtttcccgacctttaccgtagttaacccg

SEQ ID NO: 169830 - DNA, 716 bp, Homo sapiens
  misc_feature: GYAE6OF02G7UN5.37.11.A11.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctacctaaactgctcatttacngggcatccgtacccgggngtccgggtcctgaccgattcgagtcggcgaggcgggtctgggacagtatttcaacttctaccacctactaccaaacacgcctcgcgacggtccgtaggaacgggtacgttgggtacgggtaccgttaattttaacgtttacgttacggttaccgtaacggtacgtaaggtttaactttaaacgttaaactttaccctttaccccgttacccggttaacccgggtttacccgggtaaccccgtaaagggggtaaccccggtaaaggggtttaaccggaaaaacgttaaccgaaaaaccggtaaccgttaggttacgggtaccgttaacggaacccgtaacctacgtttaccgttacgtttacccgtttaccgtaaccgtttcccgtttacccccgaccttaccgttccttaaccg

SEQ ID NO: 169831 - DNA, 866 bp, Homo sapiens
  misc_feature: GYAE6OF02GEBQF.37.11.A11.1.454.CMB.1.raw
  modified_base (213)..(213): a, c, t, g, unknown or other
  misc_feature (213)..(213): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagagggcctccatcaactgacaagtccagccagtacttgttttanacgagcctaccaaacaaataagaacctacttagtcttaggtactcagacaacgaaaccgagggacacgtcctacctaaactgactctattacgtggaccactccgtacccgggaggtcccggggtaccctaggacccgtagttccgaggtcggacgtacggtcggggttacgtagggaacctacggtatttcccaaccgttcccttaccaacccgtaactacccgaaaccgtaaccggtcccgtacgggtaccgtaacgggtccggtaacgggtaacgggtacgtttacggggttagggtaaccggttttaaattttttaaccgttaacggtttacggttacccgtaggttaaacccgttaagtttaaaaccgttttaactttaaaccgttaccccgtttaaccccgggttaccccggtttaaaccgggtttacccggggtaaaaccccggtaaaacccgggggttaaaccggtaaacggggttaaccgggttaaaaaccgtaacccggtaaaaaccggttaaaccggttacggggttaccgggtccgttaaccggacccttaaaccggtacgtttacccggttcgtttacccgtttaccttaccgtttacccccgttaccccggtaccgtttacccttaccggttaacccgg

SEQ ID NO: 169832 - DNA, 930 bp, Homo sapiens
  misc_feature: GYAE6OF02GP2YT.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaaacaataagaactacttagcttggtatcagcaagaaaccgagggcacgcctacctaaactgcctctaagttttaccgtgggactaacgtccgtaaccccgggggtacggttccccggggggttaccccttacgggaacccgtatttacccgaagggttcgggaccgtacgggtccggggttaccggttacggggaaccgtaacggttaaccttttaccgtaaccgttacccgtttacccgtaaacccctaaacgttaacccgaaaacccgtaaccgggtaccccgttacgggaacccggtaaacggggtacccggttaagggtaaacgggggtaaccggtttaggggttacgggggtaaccgtttaaacggttttttaaaccgtttaaacggtttaccgggttaacccgaaagggttacccttaaagggttttaaacgttttaaacgtttaaaaccgtttaaccccgtttaccccggttaaccccgggttaacccggggttttaccccgggaaacccggtaaaaccggggggtaaacccggtaaaagggggttaaccgggtaaaaacttaacccggaaaaaaccgggttaacgttacgggttacgggtacccgttacggaacccgttaaccctaacgttacccgttacggtttaacccttaccgttaaccgtttccccgttacccccggtacccttaacgttacctaacgg

SEQ ID NO: 169833 - DNA, 644 bp, Homo sapiens
  misc_feature: GYAE6OF02IQVQG.37.11.A11.1.454.CMB.1.raw
  modified_base (134)..(134): a, c, t, g, unknown or other
  misc_feature (134)..(134): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (426)..(426): a, c, t, g, unknown or other
  misc_feature (426)..(426): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccngtctcagactccctggctgtgtctcgtgggcgaggaggcctccatcaactgcaagtccagccagtacttgttttanacngctaccaanaaataacgaacttacttagcttggtatcaagcaagaaaccagggaccagccttacctaaagtgcttacattttacgnggacactccgtacccgggnggtcccgggtcccngacctagttaccaggttcggcgaggccgggtcagggtacaggttatttccgactccgtacaacgtatccgaaactacgtccgtagccgagggtntacggaagggtatgggtagggtcttagttttaacttattcggtacaggtactagtaaatttactaactacctaccgttccgtaaccgttaccggacgtaaacgggaccgtaagggtagtaaaacgtacaaaacgtacgttaggtacgtactcgacctaaccgacgtttcgtaccgttactttctacttccccgttacccggaccttagtaccgtaacg

SEQ ID NO: 169834 - DNA, 799 bp, Homo sapiens
  misc_feature: GYAE6OF02IVHYO.37.11.A11.1.454.CMB.1.raw
  modified_base (219)..(219): a, c, t, g, unknown or other
  misc_feature (219)..(219): n is a, c, g, or t
  modified_base (334)..(334): a, c, t, g, unknown or other
  misc_feature (334)..(334): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgagacgggcctccatcaactcgacaacgtccacgccagtacttgttttaanacgagtcctaccaaactaaataacgaaaccttacgttagtccttaggtactacagacaacgaaaccgagggctacgtaccttaaccgtaaactcgtacctacgtacgtttaccgngggtacctacgttacccggtaccccggggtacggttaccccgggtcccgtacgtaacccgtagttaccgaggttaccgggaccggtacgggtccggggtacgtacgggtaccgtacgttaccgtttcaccgttaccgtacaacccgtaataacccgtaacgtacccggtaccgtacggaccgtacgggtcgtacgggtaacgttacgtcgggtacggttacgttaaacttttacgtaccgttaggtacaacggtacgtaacgtttaagttaacctaacgttacccttccggtacccggttaacccggttaccgggtaaacccgtaacggggtaaccttaacgggtaacgtaaacctaacggaaaaccgttagtacggtcggtacctacggaacctaccgtacttaccgttacggttaaccttcgttacccgttacccgttaccccgaaccgtcgttacttaccgg

SEQ ID NO: 169835 - DNA, 552 bp, Homo sapiens
  misc_feature: GYAE6OF02HDD8B.37.11.A11.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttaggtatcagcaagaaaccagggcagccctacctaaactgctcatttacgtgggcatccgtacccgggagtcccgggtacctcgaccgtatcgagtgcaggcggtcaggacagtattcgactcacaccatcaacncgctcgcaggctagagntggcgtatatttatcgtgtacagctagttatataacttcctccgtacgtcgtaccgacgaggtaaccaagggtagaaataccgaaacgagtcggtacgacgtacgactacctacgtcttaccgtacttcgaccttcccgtacccgtacctacgttcctaacg

SEQ ID NO: 169836 - DNA, 776 bp, Homo sapiens
  misc_feature: GYAE6OF02GPK1M.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcaagaaaccgagggcacgcctacctaaactgctctatttactgggcagtccgtacccggggaggtcccggggtcccctggacccgtatttccgaggttcggacgacggtcggggtcgttacggggacctaggtactttccgaactttccgtacctaacccgtaattaccaaacgaccggtcccgttaggacccgtaacgggtccgttaagggaacgggtaacgtttacgggttacgggtaccggtttaaagtttttaacgttaaccgttacggtacccgtaaggttaccttaaacggttttaaattttaacttaaacgtttaccctttaccccggtttacccggtaaccgggttttacccgggaaccccggtaaacggggtaaacccgtaaaggggttaccggaaaaacttaccgaaaaacgtaccgttgggtacgggtacttacggaaccctaaccgtacgttaccgttacgtttacccgtttacctaaccgtttccccgttacccccgacttaaccgttccgttaacg

SEQ ID NO: 169837 - DNA, 699 bp, Homo sapiens
  misc_feature: GYAE6OF02HFGR3.37.11.A11.1.454.CMB.1.raw
  modified_base (686)..(686): a, c, t, g, unknown or other
  misc_feature (686)..(686): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatggcccagtcctcagactccctggctgtgtctcgtgggcgaggacgggccctccactcaactgcaacgtccacgccagtacttgttttaatacagtcctaccaaacaaataacgaaaccttacgttagtcgttaggtactcagacaacgaaaccgagggcaacgcctaacctaactcgaccttactacgtttacgtcgggactacgttaccggtacccggggcggttcccggggtaccctaggaccgtagttcgaggtcggacgacgggtcgggtcgtacgggacgtagttacttcgacctcgtaccaacctacgtaaccaaccgtacgtcctacggacgtacgggacgtaggaggtacggttgggtacggttactttaagttttacgttacgtggtactacggttacttaaagtttaacttaacttaacttaccgtcccgttacgtaccgttaccgggacgaacgggtaacgtaagtaacgaaactacgtaaaccgagttcggacgtacgtcggacctactacttcggtacttacgtaccgttactcccgtttaccnctacttcgtaacg

SEQ ID NO: 169838 - DNA, 586 bp, Homo sapiens
  misc_feature: GYAE6OF02HG1SP.37.11.A11.1.454.CMB.1.raw
  modified_base (211)..(211): a, c, t, g, unknown or other
  misc_feature (211)..(211): n is a, c, g, or t
  modified_base (294)..(294): a, c, t, g, unknown or other
  misc_feature (294)..(294): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (542)..(542): a, c, t, g, unknown or other
  misc_feature (542)..(542): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctgggcgagagggcctccatcaactgcaagtccagccagacttgttttaanacagcctaccaaacaaataaagaactacttagcttggtatcagcaagaaaccagggcagcctacctaaactgctcatttacgngggcagtccgtacccggggacgtcccggggtccctaggacccgtattcgaggtcggcgaggcgggtcgtagggaacagtatttccgactctaccaccatacaacacgtcctgcgaggcgtaggaggntggnggacgtatttatacgtgtcagtcagttattaataacttctccgtccgtacgttaccgggaccgaaagggaccaaggtaacgaaactacgaaacgtagtggacgcgtacgcctaaccnttcgttcgttacttacgcttaccgttcccgacttagtcctaacg

SEQ ID NO: 169839 - DNA, 671 bp, Homo sapiens
  misc_feature: GYAE6OF02JICYY.37.11.A11.1.454.CMB.1.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
  modified_base (611)..(611): a, c, t, g, unknown or other
  misc_feature (611)..(611): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggcgggcctccatccaatgacaagtccagccagtacttgtttaanacngcctacaacaataacgactactancgttgactcagcagaaaccgnggcacgcctactaactgctacgtattacgngggactacgtaccgtaccgggtacgggtcccgggttacctggaaccgtacttacgaacggtcggtaccgaacgggtccgggtcgtacggggaacctaggtttacgtttaccgaactttccgaacacctaattacccaaaaccgttgcccgttaacggcgaaacgggtccgttaggaacgttaacgtggttacggactttaagtttacttaacgcggttacacgttagtaattaactaacgtactacctcccgttaggtaccgttacggacccgtaaagggactaagggtacggaaactacgaaacgtacgttggtacggntacgtaaccgtatacttctacgtttcctaacgttccttcccgacgttactacgtactacg

SEQ ID NO: 169840 - DNA, 712 bp, Homo sapiens
  misc_feature: GYAE6OF02G1OS5.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgtttttatacagcctaccaaacaataaagaactacttagcttggtatcagacaagaaaccgagggcacgtcctacctaaactgctactatttacgtgggcagtccggtacccggggacggtcccggggtccctaggaccgtattcgaggtggacgaggtccgggtgttacgggactacggttactttccgaactttccgtaccaaccctaactaccaaaccgtacgtcccgttaggaccgtacgggtcgtacgggtaggtagttcgggtacggttacggtttaattttaacgttacgttcggtaccgaaggttacttaaagttaatttaacttaaacttacccgtttcccggttaacccggttaccggtttacccgggaaccggtaaacggggtaacccgtaagggttaacgaaaacgttaaccgaaacggtacgttggtacgctacggacctaccgtatccgttcgttaccttcgtacctttcccgtacccgtacttacgtactaacg

SEQ ID NO: 169841 - DNA, 713 bp, Homo sapiens
  misc_feature: GYAE6OF02IFZK8.37.11.A11.1.454.CMB.1.raw
  modified_base (213)..(213): a, c, t, g, unknown or other
  misc_feature (213)..(213): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctggggcaggaggaccctccatacaactgcaagtccagccagacttagttttanacagacctcaaacaataagaactattagcttggtatacagacaagaaaccgtagggcacgccctactaaactgcttactaacgtttacgtgggacctaacgttcccgtaaccccggggtacggttaccccgggggtcccctacggacccgtatttccgaggttgggaacctagggtccgggtacgtagggtaccaagttacgtttaccaccttacctacgaaaccctataccgaaactccggtaccctaggcaacggggcttacgggaaggtagttgggtacggtacgtttaacttttaattcggtagtactacggtacttaagttaattaacttaacttacccgtacccttaccgggtaccggtttaccgggaacccgaaagggtaaccgtaagggtaacgtaaactaaacggtaaaccgtaagttcggttacggcctaacggtccaacgttcgtacttacgttactacgtacctccgttacccgactcgttactaacg

SEQ ID NO: 169842 - DNA, 602 bp, Homo sapiens
  misc_feature: GYAE6OF02IDNQF.37.11.A11.1.454.CMB.1.raw
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcactgcaagtccagccagacttgttttatacagctaccaacaataagaacttacttagcttgtatcagacaagaaaccgagggccacgccctacctaaactgcctctatttacngggctagtccgtaccccgggaggtcccggggtccctggtaccgattcgagttcggacgaggtcgggtctgggaacagtattcactctacaccatcaacngccgtgcaggctaggagtatggtaggtacgttaattttactaacgtgtacgaagtctaagttattaataacgttcctaccctaccggtacgttccggaccgaaaggggaccgtaagggtacgtaaacacgaaaacgagttacggcgactacggctacctagttccgtcgttacgttacctacttccctacccgacccttactactaacg

SEQ ID NO: 169843 - DNA, 516 bp, Homo sapiens
  misc_feature: GYAE6OF02F9MUG.37.11.A11.1.454.CMB.1.raw
  modified_base (287)..(287): a, c, t, g, unknown or other
  misc_feature (287)..(287): n is a, c, g, or t
  modified_base (374)..(375): a, c, t, g, unknown or other
  misc_feature (374)..(375): n is a, c, g, or t
  modified_base (389)..(389): a, c, t, g, unknown or other
  misc_feature (389)..(389): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaaactgctctaatttaccngggcatccgtacccgggacgtccggggtccctggaccgattcgagtggcaggcggtctggacagatttcgactctcaccatacaacnncctgcaggctgagntgtggagtatttatactgtcagtcagttatataatctcctcgtacgttacggacgaaggaccaggtacgaaatacaaagacgtgtgctagctacatctatccttagtactcctccccgctatctacg

SEQ ID NO: 169844 - DNA, 706 bp, Homo sapiens
  misc_feature: GYAE6OF02GGDTU.37.11.A11.1.454.CMB.1.raw
  modified_base (215)..(215): a, c, t, g, unknown or other
  misc_feature (215)..(215): n is a, c, g, or t
tcagtagtgtagatcacgaccggtgctcgatttagctacgactgcaggggcagcaagatggtgttgcagacccaggtcttcatttctctgttgctctggatctctggtgcctacgggacacgtgatgacccagtctccagactcccgtggctgtgtactcgtgggcgaggacgggcctccatcaactgacaacgtccagccagtacttgttttanactagctaccaactaaataagtaactacgttatcgttgtatcagcaagaaaccgtgggacacgtacctaccgtaaactgaccttacgtatttacgtgggcctagttaccgtacccggggtacggtcccggggtaccctggaacccgtacttcgaggtcggacggtacggtccggggtctacgggaactacgtacgttttacccaacgtttcctaacccgtacctaagttacccgaaacgcgtacccgtaggtccgaagggtcgtacggaaggtcgttacggttaggaccgtttaagttttacgtaccgttcgtacgtagttaacttaagtttaattaactaacgtacctccgtaccgttacggtaccggtaaccgacgggtaagtaacgggaataaacaccggttaaaacgattgggtacgaccgttcgaacgtacctacgttcgtccgtttacctaccgttccggtcccttccgaccgttatccggtaac

SEQ ID NO: 169845 - DNA, 536 bp, Homo sapiens
  misc_feature: GYAE6OF02GSJC9.37.11.A11.1.454.CMB.1.raw
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaaataagaactacttagcttggtatcagcagaaaccagggcagcctactaaactgctctatttacngggcatcgtacccgggagtccgggtcctgaccgtattcgagtcggcgaggtcggtcgtggacagtatttcactctcactatacaacngcctgacgtaggctgaggtgtcggtggacgttattttacgtacgtcgtacagtctagttattataactactccgtcgtacgtcgacgaggacgaggtagaatcaaacgtctgtgctgctactactcgtactccgttactcttaccgtccctactactacgtac

SEQ ID NO: 169846 - DNA, 905 bp, Homo sapiens
  misc_feature: GYAE6OF02FTN3T.37.11.A11.1.454.CMB.1.raw
tcagtagtgtagatcacgaccggtgctcgatttagctacgactgcagggggcagcaagatggtgttacagacccaggtcttcatttctctgttgctctggatctctggtgccgtacggggacaccgtgatcgacccagtcctccagacctccctggctgtgtctcgtgggcgaggacgggcctccatcaactgacaacgtccacgccagtacttgttttacacagtcctaccaaacaaataaacgaaccttacgttagtctttagggtactacgaagaccaaaggaaacccgaggggacaacgtacccctaacctaaacgtcgaccttacttaagttttaccgtcgggacctaccgttacccgggtaacccgggggtaccgggttccccgggggttacccctacgggtaacccggttactttaccggacgggttcgggacggtacggggtaccgggttacggtacggggaactaacggttacttttaccgacctttactacccgaacctaacgtaaccgaaaccgtaccgtccggtacggtacgtacgggtcgttaacgggaagggttacgttcggggttacggttaacgttttaagttttaaccgttacgttacggtaccgaacggttaaccgttaaagtttaaccttttaaacttaaaccgtttaccccgtttacccgttacccgggttaaccgggtttaccccggaaaccggggtaaaacccggggtaaccgttaaaaggggttaaacggttaaaaccgtaaaacccggtaaaaccggttaacgttacgggtaccggttaccgtaacggaacccgttaaccgttaacgttccgttaccttacccgtttaccgtaccgtttaccccgttaccccggtactaaccgttacggtaacgtaacccg

SEQ ID NO: 169847 - DNA, 649 bp, Homo sapiens
  misc_feature: GYAE6OF02GSYYR.37.11.A11.1.454.CMB.1.raw
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
  modified_base (388)..(388): a, c, t, g, unknown or other
  misc_feature (388)..(388): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttttanacacgctaccaaacaataagaactacttagcttggtatcagcagaaaccagggcagcctactaaactgctactatttacgngggacactccgtacccggggtacgtcccgggggtccctagaccgtattcgaggtggcgacggtcgggtcgtgggactagtactttcactctcactanacaacacgcctcgcgaggctaggagtagtggcggtacgttatttacgtgtcgtcgtacgtacgtacttaagttatttaataaccttaccgttacccgttaccgggttaaccggtttcccgggaaccgtaaacggggtaaccgtaaggggttaacgtaaaacgtaacgaaaacggtacgttaggttacggacgttcggaacctaccgtacttacgttacgttaccgttactaccgttccccgttacccgacctagttacccg

SEQ ID NO: 169848 - DNA, 852 bp, Homo sapiens
  misc_feature: GYAE6OF02ILS3E.37.11.A11.1.454.CMB.1.raw
  modified_base (217)..(217): a, c, t, g, unknown or other
  misc_feature (217)..(217): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagacctccctggctgtgtctcgtgggcgagacgggcctccatacaactgacaagtccgagccagtacttgttttanacagcctacaaacaaataacgtaactacttagcgttaggtactcagacaaagaaaccgagggacacgcctaactaaacgtgtactactacttttacgcgggacacgttaccggtaacccggggtacggttcccggggtaccctaggacctacgttacgaggtcggacacgggtaccgggtcgtaggggaacctagtactttaccgaccgttacctaccgaacctaacgtaaccgaaaccgtacgtaccgttcggaccgtaacggggtccttaggggaaacgggtaacgtttacggggttaacggggtaacccgttttaaagttttaacgtttaacccgttagggtttaacccgtaaggttaaccggtttaaacggttttaaaacgttttaaaacgtttaaaccctttaacccggtttaaccccggttacccgggttaacccgggtttaaccccggggaaccgtaaaaccgggggtaacccggttaaaggggtaaaccgggttaaaaacttaacccggaaaaaaccggttacgttcgggtaccggtaccttaccggaaccgttaaccctagttcccgtaaccgtttaccttaccgtaaccctttcccgtaaccccgaccttacgtacgttaaccgg

SEQ ID NO: 169849 - DNA, 788 bp, Homo sapiens
  misc_feature: GYAE6OF02H8PGX.37.11.A11.1.454.CMB.1.raw
  modified_base (211)..(211): a, c, t, g, unknown or other
  misc_feature (211)..(211): n is a, c, g, or t
tcagtagtgtagatcacgaccggtgctcgatttagctacgactgcaggggcagcaagatggtgttgcagacccaggtcttcatttctctgttgctctggatctctggtgcctaggggacaccgtgatgacccagtctccagactccctggtctgtgtctcgtgggcgagagggcctcatcaactgcaacgtccagccagcttgtttacacngctcaacaaataagaactacttagcttaggtatcagactacgaaacgtaggcaagtcctactaaactgctactattactcgggctactccgtaccgggcggttcccgggtcctacggaccgtagttcgaggttcggcgacgggtcggtcgtacgggacgtagtactttcgactacctaccaaccgtacgttaccaaacgtacggtccttagggaccgtacgggtacgtaggtacgggtaacgttcgggtacggtacgttaaacgttttaacgttaacgttggttacgtaaccggtacgttaaggtttaaacgtttaaaacgttaacgttaaccctttacccggtaacccgggtttaaccggttttacccgggaacccggtaaaaccggggggtacctaaaacgggggttaaacggtaaaaccttaaccggtaaaaaccggttacccggttagggtaccggttccggtaccggtaaccccgttaaccggttaaccgtaccgttttaaccggttcccttttaccggtaacccgttttccccggtttaacccccggtcttaacccgtaccgtttaaccgg

SEQ ID NO: 169850 - DNA, 699 bp, Homo sapiens
  misc_feature: GYAE6OF02FWXQ2.37.11.A11.1.454.CMB.1.raw
  modified_base (277)..(277): a, c, t, g, unknown or other
  misc_feature (277)..(277): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatcgacccagtctccagactccctggctgtgtctctgggcgagagggcctccatcaactgcaagtccagccagacttgtttatacagctaccaacaactaagaactacttagcgttagtatcagcaagaacgaggacacgacctactaaacngactctatttaccgtggtacacgtaccgtacccgggacgtcccgggtcctagaccgtagttccaggtcgcgacggtccggtacgtacgggacagttaacgttcgaccttcgtacacctaatacctaacacggtcctacggacgacggtccgtaggaaggtacttgggttcggtaccgttaagttttaacgttaccgtacgttactaagttacgtaacgtttaactttaaacgtaaacgttacccgttaacccggttacccggttaaccggtttaccgggaacccgtaaacggggaacccttaaaggggtaaacgaaacgttaacccggaaaacgtaacggttgtaccggtacgcggtaaccgaactccgttattccgttacttaccgttacttcccgttcccgactttaccgtacttaaccg

SEQ ID NO: 169851 - DNA, 726 bp, Homo sapiens
  misc_feature: GYAE6OF02JKSGU.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagactgttttanacagctccaacaagtaagaactacttagcttggtatcagcagaaaccaggcacgcctacctaaactgctacatttacgtgggactagtaccgtacccgggtacggtcccggggtccctcgaccgtattccgagtcggcaggtcgggtcgtgggactagtatttcgactcgtacactataccaaacgacgtcccgtgaccggtacggtcgtacggtacggagttcgggtagggtaccgttaattttacgttacgtacgtacgaggtccttaagttactttaaattaaccgttaccctcccgttaacccggttacggttacccggtacccggtaaacggggtaaccgtaacggggtttaacgaaaaccgttaccggaaaaaccgtacgttacgggttaccgggaccgtttaccggaaacccttaacccttaacggttccgttaaccggttttaccgttaacccgttaccgtttcccccgtttaaccccccggtccttaaccgtttacccgtttaaacccgg

SEQ ID NO: 169852 - DNA, 608 bp, Homo sapiens
  misc_feature: GYAE6OF02FPE7W.37.11.A11.1.454.CMB.1.raw
  modified_base (374)..(374): a, c, t, g, unknown or other
  misc_feature (374)..(374): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctccaaacaataagaactacttagcttggtatcagcaggaaaccagggcagcctacctaaactgctctatttactgggcatccgtacccgggagtcccggggtcctgaccattcagtcggcagcgggtctggacagtatttccactctcaccataccaacngcctgcaggctgacggtatggtggtcgtaatttacttacgtgtctagtacaaggttaatttaactaacgttaccttacccgttacccggtaccggttccgggacccgaaacggggtaaccaaagggttacgaaaactaccgtaaaacgtacgttaggtcggacttcggaccctaacctacgttacttcgttcctttacaccgtttcccgttaccccgccttacgttccttaacg

SEQ ID NO: 169853 - DNA, 630 bp, Homo sapiens
  misc_feature: GYAE6OF02HJSLU.37.11.A11.1.454.CMB.1.raw
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (389)..(389): a, c, t, g, unknown or other
  misc_feature (389)..(389): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctgggcgagagggcctccatcaactgcaagtccagccagacttgttttanacagctaccaacaataagaactacttagcttggtatcagcaagaaaccgngggcacgccctacgtaaactgctctatttacgngggcactccgtacccggggacgtcccggggtccctgaccgtattcgaggtggcaggcgggtctgggacagtacttcactctacaccataccaaacncgcctgcgaggctaggaggtatgggtacggtacgtattttaactacgtgtacgaggtactagttaacttagtaaactccgttacccgtaccggtacgttaccgggaaccgaacggggtaacctaagggtacgtaaaacgtacgaaaacgtacgttggtacggtacctacggtcccgtaacctacgttcgtaccgtttacttccaccgtttcccgttaccccgtacttacgttccgttaacg

SEQ ID NO: 169854 - DNA, 564 bp, Homo sapiens
  misc_feature: GYAE6OF02GH66I.37.11.A11.1.454.CMB.1.raw
  modified_base (284)..(284): a, c, t, g, unknown or other
  misc_feature (284)..(284): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaccagggcagcctcctaaactgctcatttacngggcatcgtacccgggagtccggggtcctgaccgattcagtcggcaggcgggtcgtgggacaggtatttcgacttctacacctaatcaaacacgtccctagcaggctaggaggatggtgcgtatttagtactgtcagtacgagttattaatactacctcctacgtacgttaccggaccgaagggacctaagggtagaaactaccgaaaacgtacgtggtacgtctgactacctacgtcgttacgttacttacacgttcccttaccccgctactcgtaacg

SEQ ID NO: 169855 - DNA, 689 bp, Homo sapiens
  misc_feature: GYAE6OF02IWNQI.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgaggagggcctccatcaactgcaagtccagccagacttgttttaatacagctaccaaacaaataagaacttacttagcttaggtatcagacaagaaaccgagggcacgcctacctaaactgctactatttacgtgggactacgtaccgtacccggggaggtcccggggtcccctggaacccgattcgaggtcggctaggcgggtcgtgggacagtactttacactctcaccatacaacagcctgcgaggtctaggaggtagtggtcggtacgttaattttacgtacgtcggtactaggtacttaagtttaacttattaaactacccgtacccgttacccggtacggtttacccgggaaccggtaaacggggtaaccgtaagggtaaacgtaaaccgttaaacgaaaaccgggttacgtacgggttacgggacctacgggaccctaacccgttaagttcccgttacggttccctttacgaacccgttttccccgttacccggtacccttacgttacccgttaacg

SEQ ID NO: 169856 - DNA, 752 bp, Homo sapiens
  misc_feature: GYAE6OF02HJDM3.37.11.A11.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (476)..(476): a, c, t, g, unknown or other
  misc_feature (476)..(476): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctccagacctccctggctgtcgtctcgtgggacgaggacggccctccactacaactgacctaacgtccacgccaacgtacgttnttttaanaacacgcctaccaaacaaagtaaacgaacttactagtcttaggtactacgaagacaaacggaaaaccgacgggctaacgtccctaacctaaacgtgaccttacgtaattttaacgcggactagtccccggaaccgggtccgtccccggggtcctacgaacgttcttacggagtcggacgtagggtccgggtcgtaacgggaactacgtaactttccgactaaccaccaaaccgtacaacctaaacnccgggtcctgaccgaagggtcctagggtaacgtacggtgggtcgtaaccgtttatttaacttacgtgtaccgtagacgttaagttaacttaaattaacctaccgtttacccgacggtaaccggtttccgaaaccgtaaccggggaaactaaacgggtaagtaaaaccaacgtaaaacgtaaaccggttgtacgggtctacggaccctaacccgattaaccgtcgtttaaccgttacctaccggttccctaccccgttaccgtacttaagtaacccg

SEQ ID NO: 169857 - DNA, 710 bp, Homo sapiens
  misc_feature: GYAE6OF02GOWN6.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtacttcatttctctgttgctctggatctctggtgcctacggggacaccgtgatgacccagtctccagactccctggctgtgtctcgtgggcgagagggcctcatcaactgcaagtcagccagactgtttatacngctaccaacaataagaactacttagcttggtatcgagacaacgaaaccgagggcagccctacctaaactgcctactaactttacgtgggacctagttccgtaacccgggacggtcccggggtcccttaggaacccgtacttacgacggtcggacgtacgggtcgggtaccggttagggacctaaggtactttccaaccttacccgtaccaacctacgttaaccgaaacgtacgtacccgtcgacgtacgggacgttaccggaagggtactcgggtacgtaaccgtttattttacgtaacttggactaacggtcgtaagttaactttaaagtaacttaccgtacccgttaccggtaaccggttcgaccgaaacgggaccggtaaggtaacggaaactaaccgaaacgacgttaggacgtaccgtaggaccctaaccgtacttaccgttcgttacctttacgaaccttttccccgtaaccccgcgttaccgtacgtttaacg

SEQ ID NO: 169858 - DNA, 632 bp, Homo sapiens
  misc_feature: GYAE6OF02HWS8U.37.11.A11.1.454.CMB.1.raw
  modified_base (206)..(206): a, c, t, g, unknown or other
  misc_feature (206)..(206): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagtagtgtagatcacgaccggtgctcgatttagctacgactgcagggcagcaagatggtgttgcagacccaggtcttcatttctctgttgctctggatctctggtgccgtacgggacaccgtgatgaccagtctccagacctcctggctgtgtctctggcgagagggcctccatcaactgccaagtccagcagacttgtttaanacacgctcaacaataagaactactaagcttggaatcagacagaaaaccaggcagtcctactaaacngctacgatttacngggactactacgtaaccgggacgtccgggtcctaggaacccgtnttcgagtggcgacggtcggttccagggtcaaggtaactttcgaacgttctacacgtatacgaaacacgtctaggactacggntcggaaggttcgnggtacggtagtacttttaaagtccgttactcaaaggtacgagtttaacttaataaacggttccaccgtccgttaacgtgggttacccgaaacgtacggtaaacgttggaaaaaccttcgaaaaagggttacctaggtccggtaaccgtgaacccaacgtatccggtaacttccgtacttacgccttttaccccggctatcggtttacg

SEQ ID NO: 169859 - DNA, 515 bp, Homo sapiens
  misc_feature: GYAE6OF02G3C8Z.37.11.A11.1.454.CMB.1.raw
  modified_base (285)..(285): a, c, t, g, unknown or other
  misc_feature (285)..(285): n is a, c, g, or t
  modified_base (371)..(371): a, c, t, g, unknown or other
  misc_feature (371)..(371): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (511)..(511): a, c, t, g, unknown or other
  misc_feature (511)..(511): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaccagggcagcctacctaaactgctcatttacngggcatctacccgggagtcccggggtcctgaccgattcagtggcagcgggtctgggacaggtatttcgactctacaccatcaaacngcctgcaggctgaggatggtggctaatttatactgtacagtctagttatataatcctcctccgagttcgaccgaaggaccaggtagaaactcaaacgtatggtgctagcactntctnttcgtactcgtcctccgctactntacg

SEQ ID NO: 169860 - DNA, 763 bp, Homo sapiens
  misc_feature: GYAE6OF02GQ2C4.37.11.A11.1.454.CMB.1.raw
  modified_base (277)..(277): a, c, t, g, unknown or other
  misc_feature (277)..(277): n is a, c, g, or t
  modified_base (314)..(314): a, c, t, g, unknown or other
  misc_feature (314)..(314): n is a, c, g, or t
tcagtagtgtagatcacgaccggtgctcgatttagctacgactgcaggggcagcaagatggtgttgcagacccaggtcttcatttctctgttgctctggatctctggtgcctacggggacacgtgatgacccagtctccagactcccgtggctgtgtctcgtgggcgaggagggcctccatcaactgcaagtccagccagtacttagttttactacagcctaccaaacaaagtaacgaacttacttagtcgttaggtactcaagtcaaggaaaccgngggacacgaccctactaaacgtcgctactatttacgngggctacgtccgtacccgggtcgtccgggtccctggaccgtattcgaggtcggcacggtcggtcgtagggactacgtcttaccacgttcaccgtacacgtacaaaccgtcgtaccgtacgaccgtacggtacgtagggtaaggtacgttagggttaccggggtactttaacgtttttacgttaaccgttcggtacgtaacggttaacgtaaggttttaaacctttaagttaaaccctttacccgttaccccggtttacccgggtaaccgggtttaccgggtaaaccgggtaacgtaaaccgggtaacggggttaacgtaaaaccgtaccggtaaaacggttaacgttcgggttaacgtccgttacgaccggttaaccttccgtaaccgttccgtttaacgttcccgttaaccggttcccgttaccccgtacgtttacgtaccttaccgg

SEQ ID NO: 169861 - DNA, 620 bp, Homo sapiens
  misc_feature: GYAE6OF02G1LUK.37.11.A11.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaccagggcagcctacctaaactgctcatttacngggcactcgtacccgggngtccgggtcctgaccgattcagtcggcgaggcgggtctggacagtatttcactctcaccatacaacagcctgcaggctacggaggtactgggtaggtacgttattttacgttactcgtaccaaggtcctaagttaatttaacgtaacttacccttaccgttacccggtaccggtttaccgggaacccgtaaacggggaacccgtaaagggttacggtaaaactaccgaaaaccgtaacgtggtacggactacggaccctaacctacgtccgttagttaccttactacttcccgttccccgaccttacgttacctacg

SEQ ID NO: 169862 - DNA, 643 bp, Homo sapiens
  misc_feature: GYAE6OF02HC4DY.37.11.A11.1.454.CMB.1.raw
  modified_base (294)..(294): a, c, t, g, unknown or other
  misc_feature (294)..(294): n is a, c, g, or t
  modified_base (369)..(369): a, c, t, g, unknown or other
  misc_feature (369)..(369): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagactccctggctgtgtctctgggcgagaggcctccatcaactgcaagtccagccagtactgtttatacagcctaccaaacaataaagaacttacttagcttggtatcagcaagaaaccagggcacgcctacctaaactgctctatttacgnggcactcgtaccgggagtcccgggtcctgacctagtcgaggtcggcgtaggcgggtcgaggacagtattcactcncaccgatacacagtcctgcgaggtcaggacgtagtcggtggacctttaatttacgttacgtgttacgacggtacttaaagttattaacttaaacgttccctaccggttaccggtaccggttaccgggaaccggtaaaacggggtaacgtaacgggttaaacggtaaactaacccggaaaacgtagttccgggtaggtccgttacgaaccgtaacctcgttaccgttcggttacttaccctacgttcccgttcccgaaccttagtaccgttaacg

SEQ ID NO: 169863 - DNA, 841 bp, Homo sapiens
  misc_feature: GYAE6OF02HY2O9.37.11.A11.1.454.CMB.1.raw
  modified_base (218)..(218): a, c, t, g, unknown or other
  misc_feature (218)..(218): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtcctccagacctccctggctgtgtctcgtgggcgaggagggccctccatacaactgcaacgtccagccagtacttgtttttanacacgctaccaaacaaataaacgaacttattacgtcttaggtaatcagacaacggaaaaccgaggggcacgccctaacctaaacgtcgacctactacgtttacgtgggtactaccgttaccggtaacccggggtacgggttcccggggtacccgtacggtaaccgtattcgagggtcggtacgtacggggcgggttcgtacgggaactagtttacttccgtacttacctaccgaaccctaactaccgtaaccacggtaccctacgggccggaagggtcccgttaagggacggttacgttacggggtacgggtacgtttttaacttttaaccgttacggttacggttacaacggttaacgttaaagttttaacttaaaaccgtttaacccggttacccttaccccgggtttacccggttaaacccgggtttacccgggaacccgggtaaaaccgggggtaaacccggtaagggttaaaccgggaaaaccgtttaaacgaaaacccgggttaacgttcgggttaacggtcccgtaacgacccgttaaccgttaacggttcgtttaccggttcccttaacgttcccgttacccccttaaccggtcccttaagtaccgttaaacccg

SEQ ID NO: 169864 - DNA, 784 bp, Homo sapiens
  misc_feature: GYAE6OF02HS890.37.11.A11.1.454.CMB.1.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtcctccagacctccctggctgtgtctcgtgggcgaggacgggccctccatcaactgacagtccagccagtacttagttttanacagcctaccaaacaataacgaacttacttagtcttaggtatcagacgaacgaaaccgaggacacgtccctacctaaactgtctactatttacgnggactacgtccggtacccggggtcggttcccggggtccctacggacctacgttcgaggtcggacgtacgggtccggtcgtacgggactagttacttcccgactacccgtacaacctagtaccaacgacgtccgtacgacgtaggtccgtagggaacggtacgttaggggtccggttacgtttaatttttacgttaccggttggtaaccgtaacggttacgttaacggtttaaacttttaaacgtaaaccctttcccgttaccccggttacccgggttaaccgggtttaccccggggaaacccggtaaacggggtaacccggtaaacgggttaaacggtaaaacgttaaacccgaaaacgttaccgttgggtaccgtaccgtacggtacccctaaccgttacgttaccggttacgtttaccttaccgttacccgtttacccctcccccggtaacttaccgttaccgttaaccg

SEQ ID NO: 169865 - DNA, 759 bp, Homo sapiens
  misc_feature: GYAE6OF02I3LUM.37.11.A11.1.454.CMB.1.raw
  modified_base (141)..(141): a, c, t, g, unknown or other
  misc_feature (141)..(141): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtccnccagacctccctggctgtgtctcgtggcgagcggcctccatcaactgacacgtccagccagtacttacgtttatacgacgcctaaccaaactaaataacgaaacttaacgttagtccttaggtactacgaacgacgaaacgaaaacccgagggacctaccggaaccccttaaccttaaaaccgtcgtacttaccgtaacgttttaacgtcgggacctacggttacccggttaacccggggaccgggttcccgggttaccccgtacggtaacccgttacttaacgaggttaccgggacggtaacgggccgggttagacgggtaacctaagtacctttaccgacctccgttaaccacctaactaccaacgtaccgctacgacgtaggacgtaggaacggtgtacggtagggtacgtttaacgtttaactacgttgtaccgtagacttaagttaattaacttaaccgttaccgtacccgttacggtaccgttaccggaacgtaaacggggaacctaaggttaacgtaaacgtaacgaaacgttacgttacggcgtaacgtacgacctactaacgtcttacgtacttaccgtacttacccgtaccgaccgttagtccgtaac

SEQ ID NO: 169866 - DNA, 667 bp, Homo sapiens
  misc_feature: GYAE6OF02G98TT.37.11.A11.1.454.CMB.1.raw
  modified_base (660)..(660): a, c, t, g, unknown or other
  misc_feature (660)..(660): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagcctacaacaataacgaactacttagcttggtactcagcgaagtaaaccgagggcagtccctacctaaaacgtgctctacgttttacgtcgggctacgtccgttaccccgggggaggttcccggggggttcccctggacccgtatttaccgacgggttgggccgacggtcggggttcgttaggggactacgggtaactttccgacgttccttacaccgtataccaaaccacggtccctggaccgagggtccgtaggtacggtagttagggtcgggtacgttattttaacgttacgttgccgtaggtcctagttaagttataacttacctccgttaccggtacgttccgggaccgtaaggtacggtaacggtgaaactccgaaaacggtagtacgtggtacgtcgctaccgattcgtacgttccttactcgttacccgttcccgctacncgttacg

SEQ ID NO: 169867 - DNA, 781 bp, Homo sapiens
  misc_feature: GYAE6OF02JRNBQ.37.11.A11.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (439)..(439): a, c, t, g, unknown or other
  misc_feature (439)..(439): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtggcgagagggcctccgatcaactgcaagtccagccagacttntttanacngctaccaaacaataacgaacttacttagcttaggtatactagacaacgaaaccgagggcaacgcccttacaaactgactactattacgtgggacactacccgtaccgggtacggttccccgggtaccgtacggaacccgttattaccggaggtcggtccgaagggttcgggtacgtaggaacacggttaatttccgaacttccgtaccaacctagtaaccgaaaccncgaccgttaccgagaccgggtactacgggtaaggtacgttagggtacgggtacgtttaaacgttttacgtttaaacgttcgtaacctagggtaaccttacggtttaaactttaacgttaaacccgttaccttaccgggtttaacccggttaacgttaaccccggggttacccgggtaaaaccgggtaacccggtaaacggggtttaataaaaccggttaaccggaaaaccggttaacgttcgggttacgtaccggtaccggtaaccgtaacgttaacgttccgttaacgtttccttacggttaccctttccgtaaacccgttccctacggttaccttaaccg

SEQ ID NO: 169868 - DNA, 577 bp, Homo sapiens
  misc_feature: GYAE6OF02FLZF1.37.11.A11.1.454.CMB.1.raw
  modified_base (369)..(369): a, c, t, g, unknown or other
  misc_feature (369)..(369): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaaaccagggcagcctcctaaactgctcatttactgggcatcgtacccgggagtcccggggtcctgaccgattcagtggcaggcgggtctgggacaggatttcactctcaccatcaacngcctgcaggctgaggatggtggctatttattactgtctagctagttattataactacctcctaccggtacgtttaccggacgtaagggaccgtaagggtacggtaaactaccaaaacgtaacgttggtcggtactacggtaaccaacccgtacgttccttacggtttccttacgtactttacccttcccgaccttacgtaccttaacg

SEQ ID NO: 169869 - DNA, 556 bp, Homo sapiens
  misc_feature: GYAE6OF02GWPZ4.37.11.A11.1.454.CMB.1.raw
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
  modified_base (533)..(533): a, c, t, g, unknown or other
  misc_feature (533)..(533): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagactgttttatacagctaccaacaataagaactacttagcttggtatcagcaagaaaccgagggcacgcctacctaaaactgctactatttaccagggtcagtcctaacccggggaggtcccggggtcctggaccgattcaggtggcaggcgggtctggacagtactttcgactctcaccatcaacngcctgcgaggctggacggtntgtggtacttatttactacgtgtcagctagttattataactctcctcgtacgttaccgaccgtaaggacccgaaaggttcgaaatacgaacgaacgtgtagctgaccacctactcgttcgtcttaccncgttccctcccggtctatctacg

SEQ ID NO: 169870 - DNA, 696 bp, Homo sapiens
  misc_feature: GYAE6OF02JE4XB.37.11.A11.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgagagggcctccatcaactgacaagtccagccagacttgttttanacagcctaccaanaataagaacttacttagcttaggtactcgagcaacggaaaccngggcacgcccttacctaaactgctactagtttacgcggcacttccggtaccgggagtccccggggtacctgaccgtattcgagtggcgaggccggtacgngggactagttacttcgaacctttcnccgtaccaactccgaaacgcgccctaaggcacgggacctgggaaggtactcgggtacggacgttatttacgtttacgcgttacaacggttacctaaggttaactttacgtaaaacttccctttccgtaccggttaaccggttccggaaccggtaaacgggttaccggtaaagggttaaccgaaacgttaaacccggaaacgtaacgttacggttaccgggactttaccggaaccgtaacctagttacccgtacgtttaccttaccgtaccttaccccgttcccgtacctacgttataacccgg

SEQ ID NO: 169871 - DNA, 752 bp, Homo sapiens
  misc_feature: GYAE6OF02HWJES.37.11.A11.1.454.CMB.1.raw
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
tcagtagtgtagatcacgaccggtgctcgatttagctacgactgcagggcagcaagatggtgttgcagacccaggtcttcatttctctgttgctctggatctctggtgcctacgggacaccgtgatgacccagtctccagactccctggctgtgtctctgggcgagaggcctccatcaactgacaagtccagcccagtacttgtttttanacagctaccaaacaataacgaacttacttagcttggtatcagacaagaaaaccagggcacgcctacctaaactgcttactatttacgngggacctattccgtacccggggacggttcccggggtcccctacggacccggtatttcgaaggttcggacgagggaccggggtcttaggggaactagtactttcaaccgttcctaccgaacctataccaaacacgcctgacgtacggctaggacggtagttcggtagggtaccgttaagtttttaacttaaccggtggttacaacggttccgttaaaggtttaacgtttaacttaaacttacccgttaccccgttaaccggttaacccgggtttaccgggaaacccggaaacggggttaacccgtaaggggtttaaaccggttaaaacgttaaaccgaaaacccgggtaacgtttagggtacgggttacctaccggaacctaaccccttaagttcctttaacggttaccttcccttagttacccccgtttacccggcccttacgttccttaacgg

SEQ ID NO: 169872 - DNA, 681 bp, Homo sapiens
  misc_feature: GYAE6OF02HPBEA.37.11.A11.1.454.CMB.1.raw
  modified_base (211)..(211): a, c, t, g, unknown or other
  misc_feature (211)..(211): n is a, c, g, or t
  modified_base (433)..(433): a, c, t, g, unknown or other
  misc_feature (433)..(433): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttaanacagcctaccaaacaaataacgaactacttagtcttggtatcagacaagaaaccgagggcacgccttacctaaactcgcctactaattttacgcgggacctacgttccggtaaccccggggacggttccccgggggtcccctacggacccgtattccgaggttcggcgaggtccgggtacgtcgggactagtactttccactcctacaacctataccaaacncgccctagccgtaggctaggaggtagttaggtcgggtacgttaattttaacttcgtagtacgacgtactaagttaactttaactaactaccttacccgtaccggtaccggttacccggaaccgaaacggggtaaccgtaaagggttaaccgaaactaaccgaaacgtaacgtgtacggcttacgcctaacctacgttcgttacgttaccttaccgtaccttcccgttcccgaccttagtcccttaacg

SEQ ID NO: 169873 - DNA, 823 bp, Homo sapiens
  misc_feature: GYAE6OF02JOO7S.37.11.A11.1.454.CMB.1.raw
  modified_base (206)..(206): a, c, t, g, unknown or other
  misc_feature (206)..(206): n is a, c, g, or t
tcagtagtgtagatcacgaccggtgctcgatttagctacgactgcagggcagcaagatggtgttgcagacccaggtcttcatttctctgttgctctggatctctggtgcctacgggacaccgtgatgacccagtctccagactccctggctgtgtctctggcgaggagggcctccatcaactgcaagtccagccagactgttttanacagctccaacaataagaactacttagcttggtatcagcaagaaccaggcacgtcctacctaaatcgactctatttacgtgggactatccgtaacccgggtggtcccggggtccctacggtaacccgtattccgagttcggacctacgggtcgggttctacgggaataacggttactttccgaccgttacctctaaccctagttaacccaaacgtacgtccgtaacgtccggtaacgggtacgtaccggtaagggtacggtttacgggtacggggttaccgttaaacgttttttaaacttaccgttaccggggttacaaccggggtttaaccctttaaaggttaatttttaaaaccgttaactttaaacccggttcccccgtttaaccgggttaaccccgggtttacccggggtaaccccggtaaaaggggtaacccccgttaaaaggggttaaccggtaaaaacgtttaaaccggtaaaaaccgggtaaccggtttaacggttccggggtaacgtaccggttaaccccggaactttaaccggttcgttaaccgtttacccgtttacgtaacccgtttcccgttaaccccccggtacttaccgttacgttaaaccgg

SEQ ID NO: 169874 - DNA, 677 bp, Homo sapiens
  misc_feature: GYAE6OF02G6INI.37.11.A11.1.454.CMB.1.raw
  modified_base (211)..(211): a, c, t, g, unknown or other
  misc_feature (211)..(211): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (390)..(390): a, c, t, g, unknown or other
  misc_feature (390)..(390): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctcagactccctggctgtgtctcgtgggcgaggagggcctccatcaactgcaagtccagccagtacttgttttanacagcctaccaaacaataagaacttacttagcttggtatcagcaagaaaccgngggcagcctacctaaactgctcattttacgngggcatccgtacccgggnggtcccgggtcctgaccgtattcgaggtcggcgacggcgggtcgtaggactagtattccactctcacctatacaacngtcctgcaggctggaggtatggtcgcgttaatttatactgacagtcgtaagttattaataacttacctaccgttacccggtacggtttacccgggaacccgtaaacggggtaacccgtaaagggttaacggtaaaaccgttaaaccgaaaaccggttaacggttagggtaccggtaccgtaccggtaccctaaacccgtacgttacccgttaacggtttaccctttaccgtaacccggttttacccccgttacccccggtacccgttaactttcccgttaaacccgg

SEQ ID NO: 169875 - DNA, 706 bp, Homo sapiens
  misc_feature: GYAE6OF02G1HCM.37.11.A11.1.454.CMB.1.raw
  modified_base (212)..(212): a, c, t, g, unknown or other
  misc_feature (212)..(212): n is a, c, g, or t
  modified_base (300)..(300): a, c, t, g, unknown or other
  misc_feature (300)..(300): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactcctggctgtgtctcgtgggcgaggacggcctccatcaactgccaagtccagccagtacttgttttanacagctaccaaactaaataacgaactacttagcttggtactcagacaagaaaccgaggcacgcctactaaacgtgctactatttacgngggacctacgtaccgtaccggggacgtcccgggtacctggaccgtatcgaggtcggcacgggtcgggttcgacgggtaactaggtactttaccgaacgtttccgacctaaaccgtctaaccgtaaaccgcgtcccgttcgaaccggtagggtcgaaggtacggtaggttcggtacgggttaccgtttaagttttacttaacgtcgttacgacgtactaagtttaacttacgttaactaccgttcccgtaccggtaccggtttccggaaccggtaaacggtaaccggtaaacggttaaggtaaacctaccgaaaacgttacgtacgtcggtacgtaccgaccgtaaccgtacgtccgttcgttacgtaccgttacgtacccgttcccgtacttaccgtacgtaaccg

SEQ ID NO: 169876 - DNA, 869 bp, Homo sapiens
  misc_feature: GYAE6OF02F582J.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggccctccatcaactgcaagtcagccagactgttttanacagctaccaacaataagaactacttagcttggtatcagcagaaaccagggcagcctaccgtaaactcgactctaagtttacctggggctaacgtccgtaaccccggggaacgttcccgggggtccccttacggaacccggtaatttccgaacgggttggaccgtaacgggccggggttacttacgggggaacctaaggtaacgttttaccgaaccgtttaccctaccctaaaccctaacttaccaaaacccgtaacgtcccgttacggaccgtaacgggtaccgtttacggaaaggggtaacttggggtacgggtaccgtttaaagtttttaaactttaaccgtttacgtaccgtaacgggtacctaaaggttttaaatttaaagttaaaacctttaccttaacccgtttacccggtaaccgggttttaacccgggaacccgtaaaaccggggaaaccggtaacggggtttaaacggggaaaaaccgttaaacccgtaaaaaacgggtaaacccgttaggggttaccgggtacccgtttacgggaaccctaaacccgttaccgttaccggttttaaccgggttttacccgtttaccggtaaccgttttaacccccggtttacccccggtaacccggtttaaaccttacctttaaaccggg

SEQ ID NO: 169877 - DNA, 694 bp, Homo sapiens
  misc_feature: GYAE6OF02FKV19.37.11.A11.1.454.CMB.1.raw
  modified_base (296)..(296): a, c, t, g, unknown or other
  misc_feature (296)..(296): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagacttgttttatacagctaccaacaataagaactacttagcttggtatcgagacaacgaaaccgagggcacgcctacctaaactgtctctatttacgngggacacgtaccgtacccggggtacggtcccggggtccctagaccgtattaccgaggtcggcgacggcggggttcgtgggaactagtactttcacctctacgacctataccaacacgcctgacgacggcgtaggacggtagtcggtacgggtacttaattttacgttaacgtcggtactaagttactaaggtttaatttaacgtaacgttaccgttacccgttaccggttaccggttaccggaacccggtaaacgggtaacccggaagggttacggtaaaactaacccgtaaaacggtacgttacggtacggtaccgtacgtacccaaccttacgttccgttacgttcctttaaccgtccgtttacccgttaccccgtaccttacgtaccgttaaccg

SEQ ID NO: 169878 - DNA, 842 bp, Homo sapiens
  misc_feature: GYAE6OF02HSVGH.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtcctccagacctccctggtctgtgtctcgtgggcgaggacggcctcatcaactgacaagtccagccgaagtactttagttttaactacacgtacctaccaaaacgtaaaataaacgtaaactttacttacggtcgtttaggtaactcgaagtaccgaaacggaaaaccgagggacctaacgtacccctaaccttaaacgtcgtccttaactaacgttttacggacggactacgttacccggtaacccggggtaccggttcccgggtacccctaggaacccgtacgttacgaacgggttacggaccgtacggggtccgggttaggtacgggaaccttacggtacctttacgaaccgttcctaaccgaacctaataccgaaactcgacccgttagacgtaacgggtctaaggggacggttacggttaggacgttaaccggtttaaatttttacgtaccggtttggtaacctacgtaacgttaagttaactttaaaccgtaaccgtttacccgtacccggtttaacgggtacccggtttaaccgaaccgggtaaaccgggtaaccgtaaaggggttaaaccgtaaaccttaaacggtaaaccggttacgtacggtaccggtacgtacccggaacctaaccgttacgttccgttaaccgtttcgtaaccctaccgtttaccccgtacccggtattaaccttgtaaccgg

SEQ ID NO: 169879 - DNA, 767 bp, Homo sapiens
  misc_feature: GYAE6OF02IYTEJ.37.11.A11.1.454.CMB.1.raw
  modified_base (166)..(166): a, c, t, g, unknown or other
  misc_feature (166)..(166): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctcccgtggctgtgtctcgngggcgaggacggcctcatacactcgacacgtccagaccagtacttgtttaataccgactacctaaccaaactaaacgtaaacgtaaccttaccgttaggtccgttagtactacgaaggacgaaacggaaccggacggtaccacctaccccttaacctaacgtacgtaccttacgttacgtttaccggacgggtacttaccggtaccgggtacccgggtaccgggtaccccggttaccgtaccgtaacgtagtcggtacggtgcggtacggtcggtacggtacgacgtatccgttacctaacgtccgacctacctacgtaacaccgtaccgtacgcgtagaccggtagtacggtagtacggtacgttagttacttagttacgtagtacggtactaacgtaacgttactttaacgttaccgtaccgttacccgtaccggtacccggttacggtaaccggtaacgtaacggggtaacgtaaaggtaaccgttaaacgaaccggttaacgtacggttacgccgtacgtaccgaacgttcctaacgttccggttacccttacccgttactcccggttacccgacgtaccgttacgtaccgttaacg

SEQ ID NO: 169880 - DNA, 688 bp, Homo sapiens
  misc_feature: GYAE6OF02HZQLO.37.11.A11.1.454.CMB.1.raw
  modified_base (215)..(215): a, c, t, g, unknown or other
  misc_feature (215)..(215): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (510)..(510): a, c, t, g, unknown or other
  misc_feature (510)..(510): n is a, c, g, or t
tcagtagtgtagatcacgaccggtgctcgatttagctacgactgcaggggcgagcaagatggtgttgcagacccaggtcttcatttctctgttgctctggatctctggtgcctacgggacaccgtgatcgacccagtctccagacctccctggctgtgtctcgtgggcgagacggcctccatcaactgacaagtccagccaagtacttgtttaanacacgactaccaaactaaataaacggtacttacgttacgctttacggtaatcgaagtaccgaagaaaaccgagggccacgtaccctaaccgttaaaacgtcgtcttacctaagttttaccgacgggtactaacgttccggtaaccgggacggttccccggggacctagaccgtagttcgaggttcggcgtacggtcgggtctaggacctagtcttacgacttacncaacgtataccgaacncgttcngacgtggctacggagtcgttaggcgtaagttattactacgtagactanacgttaaagttacttaataacgtaccgtcctacggtacgtaccgacgaaacgggtacctaaggtaacgtaacaacgtaaacgtacgtggtaccgcttacgaaccgttacccgagtttcccgtaacttccgttagttaaccccggttccttaccccggtaacttagtaaccttaaccgg

SEQ ID NO: 169881 - DNA, 697 bp, Homo sapiens
  misc_feature: GYAE6OF02FZT05.37.11.A11.1.454.CMB.1.raw
  modified_base (210)..(210): a, c, t, g, unknown or other
  misc_feature (210)..(210): n is a, c, g, or t
  modified_base (681)..(681): a, c, t, g, unknown or other
  misc_feature (681)..(681): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctcatcaactgcaagtccagccagtacttgttttaanacagctaccaaacaataaacgaacttacttagcttggtatcagacaacgaaaccgagggcaacgtcctaacctaaacgtgtaccttactaagtttaaccgtggggacctacgtaccgtaaccccggggacggttcccggggtaccctaggaacccgtattcgaggtcggacacgggtcgggtctgggaacagtactttcactacgtcaacctagtacaaaccgtacgcccttagggaactacgggtaccgtaagggaacgggtaacgttgggtacggtaccgttaaatttttacgtacgtagtacgagtacgtaatttaacttaaataactaccgttacccgtaccggttaacgttaccggggaacaacggggtaaccaaagggttagaaaaccttaccgtaaaacgacgttggtaggacctacggtaccaaaccgtgtaccttacggttctacgttctacccgttacccncgttaatacctaacgg

SEQ ID NO: 169882 - DNA, 725 bp, Homo sapiens
  misc_feature: GYAE6OF02JFP74.37.11.A11.1.454.CMB.1.raw
  modified_base (220)..(220): a, c, t, g, unknown or other
  misc_feature (220)..(220): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatcgacccagtctccagactccctggctgtgtctcgtgggcgagacggcctccatcactgacgaacgtccagaccagtacttgttttaacacgntacctaccaaaacaaagttaaagaaccttacgttagcgttaggtaactcgaagcaagaacgaggcacgtcctaacaactgtactctacgtttacgtcggactaacgtcccgggttacccgggacggttcccggggtaccctacggaccgtatacgtaggtccggacgagggtaccgggtcgtagggactagtacgttaccacgtacctacaccgtactaacgaacctacggtcccgtagaaccggtcggaacgtggtaaggtacgttagggtacggtaactttaagttttaaccgttacgtttacgggtactaacgggtaacttttaacgggtaactttaaactaccgtttaaccgtcccgttacccgggtacgtaccggtaacggaaaccgggtaacgaacgggtaagtaaactaaaccgaagtaacgtcgtacgacgttacgcctaacgtaaccgttcgtccgttactacggttacctacccgtaccgtcctacgtctaaccg

SEQ ID NO: 169883 - DNA, 717 bp, Homo sapiens
  misc_feature: GYAE6OF02I01P3.37.11.A11.1.454.CMB.1.raw
  modified_base (295)..(295): a, c, t, g, unknown or other
  misc_feature (295)..(295): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgacaagtccagccagacttgttttatacagctaccaaacaaataagaactacttagcgttagtatcagcaagaaaccagggcacgcctacctaaactcgctacatttacgngggacatccgtacccgggacggtccgggtccctaggaccgattcgaggtcgacgaggccgggtcgacgggacacgtactttacgactccgtacaacctacgtaccaaacctcggtcctacggaccacggggtccgtaggaacgggtattacgggtacggtaccgtttaagttttaacgttaacgtacggttaccgaacggttaacgttaacggtttaaattttaaacttaaaccgtttaccctacccggttaacccgggttaccgggtttaccgggaacccggtaaacggggtaccgtaaacggttagggaaaacctacgaaaaccgttaacgtacggtaccggtctaacgaccgtacctacgttaaccttcggttaccttacgtaccgttcccgttaccccggtactaccgtagttaaccg

SEQ ID NO: 169884 - DNA, 622 bp, Homo sapiens
  misc_feature: GYAE6OF02IMSQ8.37.11.A11.1.454.CMB.1.raw
  modified_base (138)..(138): a, c, t, g, unknown or other
  misc_feature (138)..(138): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (437)..(437): a, c, t, g, unknown or other
  misc_feature (437)..(437): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtcnccagactccctggctgtgtctcgtgggcgaggagggcctccatcaactgctaagtccagccagactgttttanacagctccaaanaataagaactacttagcttggaccagcagaaaccacgaacagcctacaagcctgcttacgttactcgggctacgtaccggaacgtccgggtacccngaacgnttcagtggcgcggtngggacagacttnactcgnaccgatcaacgtcagctagcggctagagatgtcggtacggtttatacgtcgttacgacgtacgtagttaagtttaccgnggttttaaccctaccgttacgtaacgttacggttttacggacccggttaacgggggaacctaaacgtccgggtacgtagtaaacgtccgactaaacccgggaatcggttcggagttacgacggacctacgtacttcggttacttaccgttaactcccttccccggtacctacgttccttaaacgg

SEQ ID NO: 169885 - DNA, 708 bp, Homo sapiens
  misc_feature: GYAE6OF02FZWEG.37.11.A11.1.454.CMB.1.raw
  modified_base (295)..(295): a, c, t, g, unknown or other
  misc_feature (295)..(295): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggcctccatcaactgcaagtccagccagacttgttttatacagcctaccaaacaataaagaactacttagcttggtatcaagcaagaaaccagggcagcctacctaaactgctctaatttacngggctacgtccgtacccgggaggttcccggggtccctagaccgtaattcgaggtcggctaggtcgggtctaggactagtactttcacttcgacaaccataccaactcgcctcggacgtacggtctaggaaggtagtcggtaggtacgttacttttaagttaaccggtgtacgtaaggttacgtaagttttaacttaaacgttaaaacgttacccgtttaacccggttaccgggtaacccggtttaccgggtaacccgtaaacgggggtaaaccctaaggggtaaacggtaaaactaccggtaaaaacggtaccgttacggttacgggacctacgggtaacctaacccgtacgttaccgtagtttaccttaccgtactttccccgttaccccgactttacgtaccgttaacccg

SEQ ID NO: 169886 - DNA, 577 bp, Homo sapiens
  misc_feature: GYAE6OF02FSLYL.37.11.A11.1.454.CMB.1.raw
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctacccaaanaataacgaactacttagccttgtatcagcagaacngggcancctcctaaactgactcaatttactgggtcatcgtaccgggagtccgggtcctgaccgattcagtggacaggcggtcnggacngattcactctcacatcaacngctncgngctgaggatgtgcgtatttactacgtgtacgtanctagttattataaacgttacctccgttaccgtaccgttacggtacccgaacgggtaacgtaacgggttacgaaaatcccgtaaaaagggaacttggtacggcttagacccgtaactacgttcgtacgttatttcccgattacccgtccccgtacttagtacccttaacgg

SEQ ID NO: 169887 - DNA, 647 bp, Homo sapiens
  misc_feature: GYAE6OF02IJ1WM.37.11.A11.1.454.CMB.1.raw
  modified_base (210)..(210): a, c, t, g, unknown or other
  misc_feature (210)..(210): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgtttanacagtcctacaaacaaataacgaacttacttagtcttggtatcagacaagaaaccgagggccagcctacctaaactgctacactttacgtgggcacgtccggtacccgggacggtcccggggtacctcgaccgtatcgaggtggcgtacggtcggtcgtaggactagtacttcactcacaccatacaacncgcctgcgacggntaggaacggtntcggtggtacgttatttacgtacttgacgagtacctaagttaacttattaaacgtaccttaccgtaccggttaaccggttccgggaacccgtaaaggggaaccgttaaggggtaactaaacgtaaccaaaacggaacgttggacgggtactacggcctaaccgtactcgttacgtttacctcctacgtttccccgttcccgaccgttaccgtacgtaaaccgg

SEQ ID NO: 169888 - DNA, 658 bp, Homo sapiens
  misc_feature: GYAE6OF02GWMIB.37.11.A11.1.454.CMB.1.raw
  modified_base (209)..(209): a, c, t, g, unknown or other
  misc_feature (209)..(209): n is a, c, g, or t
  modified_base (355)..(355): a, c, t, g, unknown or other
  misc_feature (355)..(355): n is a, c, g, or t
tcagtagtgtagatcacgaccggtgctcgatttagctacgactgcaggggcagcaagatggtgttacagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaacaataagaactacttagcttggtatcagcagaaaccagggcagcctacctaaactgactcattttacgtcgggctactaccgtacccggggacgtcccggggtccctggaccgattcaggtggcgagcgggttcngggacagtactttcgactctcacatacaacacgtcctgacaggctaggaggtatggtaggtcgttaatttagttaactcggtacaggacttaaggtaatttaattaaactaccttacccgtccgtaaccggttccgggaaccgtaaacgggggtaaccgtaacgggtaacgggaaaacttaaccggaaaaccggaacgttgggttaccggtacgttacggcccgtaaaccctatttacctacggtttacctttaccgtacctttcccgttaccccgtacccgttaacttaccgtttactaacc

SEQ ID NO: 169889 - DNA, 730 bp, Homo sapiens
  misc_feature: GYAE6OF02H8N78.37.11.A11.1.454.CMB.1.raw
  modified_base (152)..(152): a, c, t, g, unknown or other
  misc_feature (152)..(152): n is a, c, g, or t
  modified_base (219)..(219): a, c, t, g, unknown or other
  misc_feature (219)..(219): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgagtcgacccagtctccagcctccnggctgtgtctcgtgggacgaggacggccctcatcaactgaccaacgtccagccagtactttgtttanacagcctacaaacaataagaactacttagcttaggtactcgacgtacaaacggaaaccggtagggacacgacccttaaccgtaaagttcgcctacgttaactttacggcggacctaacgttcccgggtaaacccggggtggttccccggggtacctacggtacccgtagttacccgaagggttcggaccggtacgggtccgggttacgtacgggtacctaaggtttcttaccgacttctaaccgacgtactaaccaacgtacgccgtaacggccgtaggtcgtacggtacggtaagttcggtacggtacgttaacgtttacgttacgtacgtcgaacgttacgtacgttaattacgtaactccgtaccgttaccgtacgtacggaccgaaacggtacgtacggtaacaacgtaaccgaacgtacgtacgtacggtaccgttacgacgtacctcgttaccgttacgttacgtttacctaccgttccgtacccgccgtttactaccgttaacg

SEQ ID NO: 169890 - DNA, 525 bp, Homo sapiens
  misc_feature: GYAE6OF02FLWHO.37.11.A11.1.454.CMB.1.raw
  modified_base (211)..(211): a, c, t, g, unknown or other
  misc_feature (211)..(211): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacngctccaacaataagaactacttagcttggtatcagcagaaaccagggcagcctcctaaactgctcatttactgggcatcgtacccgggagtccggggtccctgaccgattcagtggcagcgggtctgggacagtattcactctcaccatcaacacgcctgcaggctgaggatgtggcgtatttatactgtcagtcagtattataactactcctacgtacgttcggaccgaagggaccaaggtacgaaatacgaaacgactgtcggactcgacaccattccgtgttccttctacttcccttcccgcctatctacg

SEQ ID NO: 169891 - DNA, 779 bp, Homo sapiens
  misc_feature: GYAE6OF02F6K9C.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgtttanacagctccaacaataagaacttacttagcttggtatcagcaagaaaccgagggcacgcccttacctaaaacgtgccttactaatttttaccgtggggacctacgtacccgtaacccccgggggaggttccccggggggtaccccttaggaaccccgtagttttcccaagggttcggacgtaggtccggggtccgtgggaacacggtatttccaccgttcctaccaaccctatacccaaaccacggtacccgttgaccgtaggtccgtaggaggtacgtgggttagggtaccggttaatttttaattaccggttagttaccgtaacggtcgttaacgtttaactttaagttaaaccgttaccctttcccggttaacccggttaccgggtttaccggtaacccggtaaaacggggtaaccccgtaaaaggggtttaacggaaaaccgttaaccggaaaaacgtaaccgttacggttacggtaccgttacggaccctaaaccgtacgttcccgttacgtttaccgtttacctaccgtttccccgttaccccggcccttacggttacctaaccgg

SEQ ID NO: 169892 - DNA, 804 bp, Homo sapiens
  misc_feature: GYAE6OF02HJOX7.37.11.A11.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctcccgtggctggtgtctcgtgggcgagacgggcctccatcaactgcaacgtccagccagtacttagttttacacngcctaccaaanaataacgaacttacttagcttggtatcagacaagaaacgagggcacgtcctacctaactgcctactatttacgcgggactacgttaccggtacccggggtcggtcccggggtcctacggaccgtagttcgaggtcggacgtacggtcgggtcgtacgggactacgttacttaccgacttaccctacaccgtactaccaaacgtccgtcccgtggaccgtacgggtaccgtagggtaacggtagttcgggtacgggttacctttaaagtttttaaccgttaccggttgtaaccgtaaggttaaccgtttaaagtttaaccgtttaaaacttaaacccgtttaccccgttaccccgggtttaacccgggtacccgggtttaacccgggaaaccgggtaaacggggtaacccggtaaggggttaaaccgtaaaacttaaccggaaaaaccgggtttcgttacgggtaccgggtacttaccggaacccttaaccgttacggtttccgttaccgtttaccccttacggttaaccctttcccccgttaacccggtcctttaccggttacttaaacccgg

SEQ ID NO: 169893 - DNA, 629 bp, Homo sapiens
  misc_feature: GYAE6OF02IULLS.37.11.A11.1.454.CMB.1.raw
  modified_base (207)..(207): a, c, t, g, unknown or other
  misc_feature (207)..(207): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctcatcaactgcaagtccagccagacttgttttanacagctaccaacaataagaactacttagcttggtatcagcaagaacagggcacgcctacctaaactgctctatttactagggcattccgtacccgggtaggtcccggggtacctcggaccgtattcgacggtggcgaggcgggtacgtgggacaggtactttcactactcaaccgtactacaaccgtacgccgttgacgtacggctaggtaaggtagtgggttcgggtacgttaagttttattaacgtcgtactaggtactagtttaattaacgttacttacctccgttacccgtacgttaccggaacccgtaagggtaacccgtaagggacgtaaaacaccgtaaacgtacgtggtacggctacggcctaaccacgttactacgttgttactacttaccgttacccgcctacgttctaacg

SEQ ID NO: 169894 - DNA, 747 bp, Homo sapiens
  misc_feature: GYAE6OF02HT74Q.37.11.A11.1.454.CMB.1.raw
tcagtagtgtagatcacgaccggtgctcgatttagctacgactgcaggggcagcaagatggtgttgcagaccccaggtcttcatttctctgttgctctggatctctggtgcctacggggacaccgtgatgacccagtcctccagacctccgtggctgtgtctcgtgggcgaggacgggcctccatacaactgactaacgtccgacgccgagtacgttagtttttacacacgtacctaacccaaactaaactaaacgtaaccttacgttagtcgttaggtactacgagtacgaacggtaaaccgacgggacacgtccctaacctaaactcgtaccttactacgtttacgtcgggacctacgttacccggtacccgggggtaccgggttccccgggtaccgtacggaccgtagttacgaggtcggacgacgggtcggtcgtaggacgtcgtacttaccgacttcgtacactacacacacgcgtcgcgacgcgtacggagtagtcggtagtacttagtttacgactgacctagtaactagttaacttacgtaaccttccgttacccgttcggtacccggttaccggaacccggtaagggtaacccgtaacggggtaacgttaaaaccgtaaccggaaaacgttccggtgggtaccgtaccggtaactacccgtaaccgttacgttaccgttaccgttccgttaaccgttcccggttaccccgttacccggactttaccgtacggttaacc

SEQ ID NO: 169895 - DNA, 687 bp, Homo sapiens
  misc_feature: GYAE6OF02IQ1IS.37.11.A11.1.454.CMB.1.raw
  modified_base (217)..(217): a, c, t, g, unknown or other
  misc_feature (217)..(217): n is a, c, g, or t
  modified_base (319)..(319): a, c, t, g, unknown or other
  misc_feature (319)..(319): n is a, c, g, or t
  modified_base (450)..(450): a, c, t, g, unknown or other
  misc_feature (450)..(450): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggacgggcctccatcaactgacaagtccagccaagtactttgttttanacacgcctacccaaacaaataaacgtaaccttacttagtcgtttggtaactcaagacaagaaaccgagggcacgcctaacctaactgactactaattttcgngggactacgttccggtacccggggacggttcccggggtcctcggaaccgttattcgaggtcgggcgtagggtccgggttcgtagggactaaggttcttaccacgttcctaccaacccgtaataccgaaacncggtcccgtagaccggacggtcgtagggaacggttggtcgggtacggtacgtttaattttacgttaccgtgtacgaacgtattagttaattaactaacgttccctaccgttaccgtacggtaccggaacggaaacgggtacgtaacgggtaagaactaacgtaaagtcgtaggtacgctacggacctaccgtattccgttagttaccttctaccgtttcccaccgtactgtactacg

SEQ ID NO: 169896 - DNA, 704 bp, Homo sapiens
  misc_feature: GYAE6OF02GJ055.37.11.A11.1.454.CMB.1.raw
  modified_base (211)..(211): a, c, t, g, unknown or other
  misc_feature (211)..(211): n is a, c, g, or t
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaacgtccagccagacttgttttanacagcctaccaaactaaataacgaacttacttagcttaggtatcagcaagaaaccgaggcacgcctacctaactcgctactatttaccgngggactacgtccgtacccggggaggtcccggggtcctacggaccgtattcgngtcggcaggtcgggtcgtagggacagttacttccactccacaccaataccaactacgcccgttagacgacggtcgtaaggacggtagtcggtaggtacgtttaatttacgttacgtcgtacgtagtacgttaagttaaagttaaccttaaccgtacccgtttaccccgttacccgggtaaccgttttaacccggggaacccggtaaaacggggtaacccgtaaaggggtaaccgtaaaaccgttaaacgaaaacccgggtaacgttgggtaccgtaccgtcgaacccgtaaccgttacttcgttaaccgttcttacccgtacttccccgtacccgtctacgttacgtaacg

SEQ ID NO: 169897 - DNA, 940 bp, Homo sapiens
  misc_feature: GYAE6OF02GSPF0.37.11.A11.1.454.CMB.1.raw
  modified_base (158)..(158): a, c, t, g, unknown or other
  misc_feature (158)..(158): n is a, c, g, or t
  modified_base (229)..(229): a, c, t, g, unknown or other
  misc_feature (229)..(229): n is a, c, g, or t
tcagtagtgtagatcacgaccggtgctcgatttagctacgactgcaggggcagcaagatggtgttgcagacccaggtcttcatttctctgttgctctggatctctggtgcctacggggacacgtgatgacccagtcctccagacctcccgtggctgtntctcgtgggcgaggaggccctccatcaactgacaacgtcccaggcctaaggtactttgttttaactaaccngtacctaaccaaactaaataaacgtaaccttaccttaagtcgtttaggtactacgaacgacctaaaggaaaacccgaacggggtccaacgtaccccttaaccctaaaacgtcgtccttaccttaaagttttaccgtagggggaccttaacgtccccgggttaaaaccccggggtccgggttcccccggggtacctaccgggtaacccgttagtttaccggtaaggttccgggaccgtaacggggtcccgggttacggtacggggtaactaggtttaaccttttccgaacctttctacccgaaacctactaccccgaaagtcccggaccgtttggaaccgtacccgggtgtaacgggtaacggtacgggttacggttaacggggtacggttttaaacgttttttaacccggtttaaccgttacggttaccgtaacggttaaccgtttaaggtttaaactttaaagtttaaccctaacccggttttccccggtaacccgggttaccgggttttacccgggaaacccggtaaacggggttaaacccgttaaggggtaaccgttaaaaaccgttaaccgtaaaaccggacgtttaccggggtttacgacccggttacgtaaacccgtaacctttaaccgttccgttaccgttttaaccctttaccgtaaaccgttttcccgtacccccgttacgttaaccgtttcttaaacccgg

SEQ ID NO: 169898 - DNA, 640 bp, Homo sapiens
  misc_feature: GYAE6OF02HZ9E4.37.11.A11.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
  modified_base (496)..(496): a, c, t, g, unknown or other
  misc_feature (496)..(496): n is a, c, g, or t
  modified_base (604)..(604): a, c, t, g, unknown or other
  misc_feature (604)..(604): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccgagactcctggctgtgtctcgtggcgagacggcctcatcaactgacaacgtccagccagtacttgttttanacgagactaccaaanaaagtaaacgaacttattagtcgttaggtactcgagacaagaaaccgagggcacgcctacctaatcgactactatttacgnggactagtaccggaccgggtcgtccggtacctgaccgtattccgaggtcggctacgggcggtcgtacggactagttacttcactcgtacaactcaacgtaacacgtctacgcgtacggcgtggaaggtcgttcggaacggttacttagttttactacggtagtccgtaagtacttaagttacttaanaacgttccgtacgtaccgtcggtaccgagtaacgaacggtaagtacgtaactaacgaaccgttagtcggtacgaccgttacaaccgtcctagtcgtttaccgaccttnttacccgtcccgttaaccggatttccggattaaccg

SEQ ID NO: 169899 - DNA, 734 bp, Homo sapiens
  misc_feature: GYAE6OF02I1X2Z.37.11.A11.1.454.CMB.1.raw
tcagtagtgtagatcacgaccggtgctcgatttagctacgactgcgaggggcagcaagatggtgttgcagacccaggtcttcatttctctgttgctctggatctctggtgcctacggggacaccgtgatcgacccagtcctccagtacctccctggctgtgtctcgtgggcgaggacgggcctccatcactgacagtccagccagtacttgtttacacagtcctaccaaactaaataacgtaacttacgttacgtcgttaggtatcagacgaaaggaaaccgacgggacacgtacctaacctaaacgtgtacctactacgtttacggcggtacctacgttacccggtaccccgggggtaccgggttacccgggtacctaacgaccccggttagtaccggaggtcggaccggtacggtccgggtacggttagggactaggttactttcccactcctaccaactactaccgaaaccgtctacccggtagtacgacgggctagggagtagtaggtcggtatttaatttacgttagtccgtactaagtacgtaagttaacttaacgttaaacctcccgtacccgtaccggtacggtaccggaaccggtaacgggtaacggtaaggtaacgtaaacgtacctaaaggtacggttacgtacgtaccgtaacgaccctactacgttccgttaacttccgttaccgttaccgtttacccgacctaccgtagttaccctacgg

SEQ ID NO: 169900 - DNA, 630 bp, Homo sapiens
  misc_feature: GYAE6OF02F15WR.37.11.A11.1.454.CMB.1.raw
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttatacagctaccaacaataagaactacttagcttggtatcagcaagaaaccagggcagcctacctaaactgctctatttacgngggactatccgtaccgggngtcccgggtcctaggacccgtattcgagtggcacggcgggtctgggacagtatttcactctacactataccaacncgcctagcacggtcaggacggtntgtggaccgttatttacttactntcgagtactagtttataataacttacgtccttaccggtacgtaccggacgaaacgggtaaccgtaagggtacggaaaactacggaaaaacgtccgttagggtacggacgttaccggaactaacctacgtttaccgttacgtttcccggtttactaccgttttaaccccggttccccgaccttacggtttaccttaaaccgg

SEQ ID NO: 169901 - DNA, 591 bp, Homo sapiens
  misc_feature: GYAE6OF02I2S8D.37.11.A11.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (291)..(291): a, c, t, g, unknown or other
  misc_feature (291)..(291): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggaggcctccatcaactgcaagtccagccagacttgttttanacagctaccaanaataagaactacttagcttggtatcagcaagaaaccgaggacacgtcctacctaaactgctcatttacnggcagtccgtaccgggagtcccgggtacctgaccgatcagtcggacacggcggtactggacagtacttcactctacacatacaactcgactgcgaggtctaggaggtactcggtagtacgttaagttttactacgtgtaccgagtaactagttaattaacgttaactacgtccgtaccgtacgttaccgggaccgtaacgggacctaagggttacgaaattacgaaacgtacgtggtacgtcgtacgactaccgtagtccttagtccttctaccttccgtacccgacttacgtcttaacg

SEQ ID NO: 169902 - DNA, 817 bp, Homo sapiens
  misc_feature: GYAE6OF02G9EDG.37.11.A11.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgactgacccagtcgtccagacctccgtggctgtgtctcgtgggacgaggacggcctccgatcaactgcaagtccagccagtacttgttttacacagcctaccaaanaataacaacttacttagtcttagatcacgtacaagaaaccgngggacacgtacccttacctaaagtcgtacttactacgtttacggacgggtactacgttacccggtaacccgggtaccgggttccccggggttacccctacggtaaccggttaactttcggtaacgggttccgggaccgtacgggttccgggtacggtacgggtaacctacggttacttttccaactttccgtaccaacctaacttaccgaaaaccgcgtacccgttcggaacgacggtcgttagggacgtaggtcggtacggtagtttaacttttacgtaactggttacctaaggtaccgtaaatttaacgttaacttaaaccttaccggtttaccccgttaaccgggttacgttaaccccggggtaaccggaaccggttaaacggggttaaaccgggttaagtaaaaacccgtacggttaaaaaccgtaggttcggtaaccgggttcgtaccggtaaccctaaccggtagtttacccgttacgtttaccccttagttaccccgttttaccccggtaccctacgttaccgtttaaccgttaacg

SEQ ID NO: 169903 - DNA, 687 bp, Homo sapiens
  misc_feature: GYAE6OF02GH9PJ.37.11.A11.1.454.CMB.1.raw
  modified_base (217)..(217): a, c, t, g, unknown or other
  misc_feature (217)..(217): n is a, c, g, or t
  modified_base (334)..(334): a, c, t, g, unknown or other
  misc_feature (334)..(334): n is a, c, g, or t
  modified_base (499)..(499): a, c, t, g, unknown or other
  misc_feature (499)..(499): n is a, c, g, or t
  modified_base (539)..(539): a, c, t, g, unknown or other
  misc_feature (539)..(539): n is a, c, g, or t
tcagtagtgtagatcacgaccggtgctcgatttagctacgactgcaggggcagcaagatggtgttgcagacccaggtcttcatttctctgttgctctggatctctggtgccgtacggggacacgtgatgacccagtctccagacctcccgtggctgtgtctcgtgggcgaggacgggcctccatcaactcgacaacgtccagccagtacttgtttanacagtcctaccaaacaaataactaacttacgttagtcgttagtactcaacggtacaaccgaaaacgacgggacacgtaccctaaccctaaactcgtaccttacttaacgtttaccgngggtacctacgtcccgggtaacccggggtaccggggtttcccggggtaccctggaacccgttagttacgacgggtcggcggtacggtcgggtacggttaggactaacggttacttccacgtctaccaactactacaacgtccgcgtcgacgagtcgaggcgtagnggtagtacttagtttctagtacgtacgtaatgtaaagttnttaactaacgttccgtaccgtacgttacgggtaaccacggaacgggttaaccggaggttaacgaaacgtaccgtaaagtagtaggtccggactacggaactaacgtctaccgttgtacttcgacttcccggtcaacttcggtactccg

SEQ ID NO: 169904 - DNA, 807 bp, Homo sapiens
  misc_feature: GYAE6OF02GQOF8.37.11.A11.1.454.CMB.1.raw
  modified_base (265)..(265): a, c, t, g, unknown or other
  misc_feature (265)..(265): n is a, c, g, or t
tcagtagtgtagatcacgaccggtgctcgatttagctacgactgcaggggcgagcaagatggtgttgcagacccaggtcttcatttctctgttgctctggatctctggtgcctacgggacaccgtgatgacccagtctccagactccctggctgtgtctctgggcgagagggcctccatcaactgacaagtccagccagactgttttatacagcctaccaaacaataaagaacttacttaagcttaggtatcagcaagaaaccgnggcacgcctacctaaactgactactaatttaccgtgggactagtaccgtaaccccggggtagttacccggggtccctaggaccccgtaagtttccgaaggttcggacacggtccggggtacctgggaacctacgtaacgtttccgaacttcctaccgaaccctagtacccaaacgtaacggcccgttacggaccgtaacgggtccttacgggacggtaacgttcgggttacgggtacccgtttaaatttttaaccgttaaccgtttacgggtaccctaaggtacccttaaagggttttaaactttaaacgtaaaccgtttaccctttaccccggtacccggtttaccgggttaacccgggacccggtaaaggggtaaaccccgtaaaggggtttaacgaaaaccgttaaccgtaaaaaccgggtaaccttcgggttacggtaccgtacggaaccccgtaaccgtaaaccgtttccggttaaccgtttaccgtaaccgttccccgtttaacccggtcccttaacgttaccttaccggtaaacc

SEQ ID NO: 169905 - DNA, 662 bp, Homo sapiens
  misc_feature: GYAE6OF02HB2ON.37.11.A11.1.454.CMB.1.raw
  modified_base (315)..(315): a, c, t, g, unknown or other
  misc_feature (315)..(315): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctggggcgagagggcctccatcaactgcaacgtaccacgccagactgttttattacagcctaccaacaaataagaactacttagcttggtatcagcaagaaaccagggcacgcctacctaaactgctcatttacgtgggcattccgtacccggggnggtcccgggttcccgtagaccgtattcaggtgggtccagggccgggttcgtacgggacgtagtagtttccacctactcgaaccctaagttccaaaaccgtcgcccttgacgtaacggcgttacggagggtactggtacgggtacgtatttttaacgttacgttctacgtaagtcgtaagtttaactttaataactaccgttcccgtaccgtaaccggtttcggaaccgtaaagggaccgtaaaggtcggtaaaataccgaaaccgaagttcggtacggacctcgaacccaccgtacttcgtagtttcccgttaactccgttccctttaccccgcttactccgttacg

SEQ ID NO: 169906 - DNA, 788 bp, Homo sapiens
  misc_feature: GYAE6OF02JAPZM.37.11.A11.1.454.CMB.1.raw
  modified_base (211)..(211): a, c, t, g, unknown or other
  misc_feature (211)..(211): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactcccgtggctgtgtctcgtgggcgagagggcctccatcaactgacaacgtcagccagacttgtttanacagtcctaccaaacaataacgaacttactacgtcgttaggtatcagacgaacgaaaccgaggcacgtaccctacctaaactcgtaccttactagttttacgcgggactacgttaccggtacccggggtacggtcccggggtccctaggacccgttatacgtaggtcggacgacggtcgggtccgtagggactagttacttaccgaccgtcctaccaacctactaccgaaacctccggtcccttacgggacgaccgggtcgtacgggtaaggtagttcgggtacggttacgttaagttttacttaaccggtgtaccgtaacgtacgtttaaacgtttaatttaaacgtaaacctttacccgtaacccggttaccccggttaaacggtttcccgggaaaccggtaaaccgggtaacccggttaaagggtaaccgtaaaacgtaacccggtaaaaacggtaccgttacgggttacggtaccttaaccggtaacctaacccgttcgttaccgttaccgtttaccgttaccttaacccggtttccccgtaaccccgtacttaaccggttacctttaaccgg

SEQ ID NO: 169907 - DNA, 851 bp, Homo sapiens
  misc_feature: GYAE6OF02IH9XR.37.11.A11.1.454.CMB.1.raw
  modified_base (784)..(784): a, c, t, g, unknown or other
  misc_feature (784)..(784): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatcgacccagtcctccagacctccctggctgtgtctcgtgggcgaggacgggtcctcactacaacgtgaccgaacgtccagccgaagtactttgtttaacacgagtacctaccaaaactaaagtaaacgtaaacttacgttaacgtcgtttaggtactacgaacgaccgtaaacggaaacccggagggacctacgtaccccttaacctaaacgtcgtaccttacgttaacgttttaccgtcggggacctaacggttaccccgggttaaccccgggggtacgggtttcccccgggggtacccttacgggtaacccgttgttaccggagggtcggtaccggtacgggtccgggtacgtagggtacctagttacctttaccgacttacccgtaccgtaacctacgtaccgaaacgtaccgtccgtacggcggaaccgtcgtagggaacgtggttacgggtacggttactttaaacgtttacgttacgtggtaccaacggttactaaacgtttaatttaaaccgttaacgttacccgttacccggtaccggttaaacccggtcgggtaaacccgggaaacgggtaacgttaagggtaaccgtaaaacgtaaaccgaaacgggttagtacggtacggtaccgtacgtaacccgttaaccgttnttaaccgttcgttacccgttacttacccgtttaccccgtacccgtaactttaccgttaccgttaacg

SEQ ID NO: 169908 - DNA, 671 bp, Homo sapiens
  misc_feature: GYAE6OF02FVIH1.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttanacagctaccaaacaataaagaactacttagcttggtatcagacaagaaaccgagggcacgcctacctaaactgctactatttactggcagtccgtacccgggtacgtcccggggtcctagaccgtacttcgagtcggcgacggtcgggtcgtcgggactagtacttcaccgtcctacgaaccactaccaaactacgtccgtcgacgacggtctaggacggtagtaggtcgggtacgtagttttaacgttacgtagtcgtacggtacgttaagttaactttaataaccttaccgttcccgttaccggtaccggttacccggaaccggaacgggtaaccgtaagggttaacgtaaacctacgtaaaccgacgttaggtacggtccgtacgccgaaccttaccgtcgtttccggttaccttacgtcctttaccccggtaccctaccgttaccgttacttaacgg

SEQ ID NO: 169909 - DNA, 820 bp, Homo sapiens
  misc_feature: GYAE6OF02IZ6AL.37.11.A11.1.454.CMB.1.raw
tcagtagtgtagatcacgaccggtgctcgatttagctacgactgcaggggcgagcaagatggtgttgcagacccaggtcttcatttctctgttcgctctggatctctggtcgccgtacggggcaccgtgatgacccagtctccagactcctgctgtgtcctcgtcgggacgagacgggtccctcctatacgtaacgtcgacgaacgtaccaggccacggtacctttagtttttacacgtacgtacctacccaaacgtaaacgtaaacgtaacttacgttacgacgtttacggtaattcgaacgtaccgaaagtaaaccgaggggacctacggaccccttaaccgtaaaacgtccgaccttactaacttttacggaccgggtacctacggtttaacccggtaaccccggggtacccggttacccggggttacctcggtaacccggtaacggtttccgagggttcggaccggttacgggccgggttacgtggacgtacgttaccttacctacggtacctacgtaactaacgtacctaacgaccgtccgttaaccgcgagttacggacgaggttacgtacggttcggtacgttttaacgtttaacttacggtagtacgttagaacgttaattaacgtaacttacgtttaaccctaccggttccgtaaccgggtttaaccgaaccgggtaacggtaaccggtaaggtaaaccgtaaactaaacgtaaaccgtagtaccggtcgtaccgtacgaacgtaaccttacggttaccttcggttactttaccgccgttttaccgtacccgtactacccttaggttaacc

SEQ ID NO: 169910 - DNA, 643 bp, Homo sapiens
  misc_feature: GYAE6OF02FTIWK.37.11.A11.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (411)..(411): a, c, t, g, unknown or other
  misc_feature (411)..(411): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaanaataagaactacttagcttggtatcagcagaaaccagggcacgcctcctaaactgactctatttactgggctacgtccgtacccggggaggtcccggggtccctgaccgtattcgagtggcgaggcgggtcgtgggacagtactttcactcctacaccataccaacacgtcctgaccgaggtctaggtaggngtaggtggtacgttaattttacgttaacgttcgtacgtagtacgtaagttaacttaattaaacttaccttaccgttacccgtaacggttaccggaacccgtaacggggtaacccgtaagggtaacgtaaactaacgtaaacgtaacgtagtacggtcgtacggcctaaccgtacttccgttacgttaccgttcgaccgtttcccgttcccggaccttaccgttccgttaacg

SEQ ID NO: 169911 - DNA, 509 bp, Homo sapiens
  misc_feature: GYAE6OF02FIGEU.37.11.A11.1.454.CMB.1.raw
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
  modified_base (488)..(488): a, c, t, g, unknown or other
  misc_feature (488)..(488): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctcaacaataagaactacttagcttaggtatcagcagaaaccagggcagcctcctaaactgctcatttactgggcatctacccgggagtccgggtcctgaccgattcagtggcagcgggtcnggactagntttcactctcaccatcaaacagcctgcaggctgagatggtgngtatttatactgtcagcagttatataatactcctcgacgttcgaccgaaggaccaaggtagaaactacgaaacgactgtagcgtgcaccgtatcctgtaccttnacttccttccggctatcgtag

SEQ ID NO: 169912 - DNA, 678 bp, Homo sapiens
  misc_feature: GYAE6OF02G1QXT.37.11.A11.1.454.CMB.1.raw
  modified_base (208)..(208): a, c, t, g, unknown or other
  misc_feature (208)..(208): n is a, c, g, or t
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
  modified_base (422)..(422): a, c, t, g, unknown or other
  misc_feature (422)..(422): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctcagactccctggctgtgtctcgtgggcgagaggcctccatcaactgcaagtccagccagacttgttttanacagcctaccaaacaataacgaactacttagcttggtatcagcaagaaaccgngggcagcctacctaaactcgtactactatttacgngggctacgtccggtaccccggggtaggttcccggggtccctacggtaccgtattcgaggtcggcgaggtcgggtcgtaggactagtctttacacttcctacaccataccaacgacgtccgtgacgnggacgtaggagtgttggtgtacttagtttactacgtgtacgtacgtactagttattataacgttacctccgttaccgtaccggttaccgacgggtaaacgggtaccgtaaagggtaccgtaaaacgtaccgtaaaaccggtacgttacgggttacgaccgttaccggacccttaaccgtacgtttaccgttacccggtttaccttaaccgttaccccggttccctttaacccccggtcttaccgttccgtaaaccg

SEQ ID NO: 169913 - DNA, 613 bp, Homo sapiens
  misc_feature: GYAE6OF02IUXNF.37.11.A11.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (358)..(358): a, c, t, g, unknown or other
  misc_feature (358)..(358): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgagaggcctccaatcaatgcaagtccagccagtacttgttttanacagctaccaaanaaataagaactacttagcttggtatcagcaacgaaaccgaggcacgcctacctaaacgtnctctatttacgngggacacgtcgtaccgggaggtccgggtaccngactagttacagtgcagtcgggtctgganagtattccaactctacaccatacaacacgccctgaccgtaggcgtagaggagttcggtaggtacgttaatttaacgttacgttgacgtaacgtacgtaagttaacttaattcgttaacctttaccgtaacttaccgttaaggttttcggaaccgtacggggtaacaacgtacggtaggtaagactacggactaacgtaacgtggtaccggtcgacgtaccactactcgttacgttctactacgttccgtaccccg

SEQ ID NO: 169914 - DNA, 707 bp, Homo sapiens
  misc_feature: GYAE6OF02HLTG3.37.11.A11.1.454.CMB.1.raw
  modified_base (308)..(308): a, c, t, g, unknown or other
  misc_feature (308)..(308): n is a, c, g, or t
  modified_base (446)..(446): a, c, t, g, unknown or other
  misc_feature (446)..(446): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagacttgttttaacacagcctaccaaactaaactaaacgaactacttagtcttggtaatcagacaacgaaaccgagggcacggacctacctaaactgacctctacttttacgnggacctagttacccggtacccggggtaacggttcccggggttacccctcggaaccgttattacggagttcggaccgtacggtcggggttcgtcgggactaagttactttcgaccttaccgtccgaacctaatccgaanccgacgtccgtcgacgtacggacctaggaaacgtgttggtacgtactttaacggttttactttcgtacgttcgttagtacgttagtttagttttaccgggtcttcccggttcgttaccgtttacggaccggtacgtaacggggaacgttaacgggtagggtacaagtaccgtaacggtacgtaacggttcgtcgggaccttacgaacccttacgacgtttccgttacggttcctttacgaccgttcccgttaccccgaacg

SEQ ID NO: 169915 - DNA, 576 bp, Homo sapiens
  misc_feature: GYAE6OF02GRN9P.37.11.A11.1.454.CMB.1.raw
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagtagtgtagatcacgaccggtgctcgatttagctacgactgcgtagggggcagcaagatggtgttgcagacccaggtcttcatttctctgttcgctctggatctctggtgcctacgggacaccgtgatgacccagtctccagactccctggctgtgtctctcgggcgtagaggcctccatcaactgcaagtccagccagactgtttanacagctccaaacaataaacgaactaacttagcttaggtatacagacaagaaacctaggcagcctactaaactgacctcaatttaccngggactagtccgtaccgggagtccgggtcctgaccgatcgagtggacagcggtcctaggacagtattcgactcncacatacgacagcctagcagtcngaggtatgtacggctatttactatgtcagtacagttaagtaataacgtacctaccgaccgtacgtacggacgtaaacgggtacctaacggtacgtaaaacgtcaaacgtaacgtgtacggacgtacgccgtaaccgacgtagttacgtacgttacgacctccgttacccgctactctaacg

SEQ ID NO: 169916 - DNA, 682 bp, Homo sapiens
  misc_feature: GYAE6OF02F02F6.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggagggcctccatcaactgcaagtccagccagacttgttttaatacagctaccaaacaataagaactacttagcttggtatcagcaagaaaccagggcacgcctacctaaactgcttactatttacgtgggctacgtccggtaaccccggggacggttcccggggtccctgtaacccgtattccgaggtcggcgacggtcgggtacgtgggaactaggtacttcgactctacacctatacaacgacgtcctggacaggtcgtaggacgggtatgggtacgggtacttaattttacgtacgttggtacgtaggtacttaagtttaattaacgttaacttacccgtttacccgtaccggtaaccggtttccggaacccgtaaaggggaaccgtaaacggggttacaaaacgtaacctaaaacgggtaccgttggtacgtaccgtacgtacctaacctcgtaccgttacgttcttaccgtacctttaccccgtcccgtaccttactccgttaaaccg

SEQ ID NO: 169917 - DNA, 827 bp, Homo sapiens
  misc_feature: GYAE6OF02I38NL.37.11.A11.1.454.CMB.1.raw
  modified_base (275)..(275): a, c, t, g, unknown or other
  misc_feature (275)..(275): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtacttgttttaactacagcctaccaaacaaataaacgaaccttacttagcgttaggtatcgagcaaacggaaaccgngggcaacgcccttacctaaactcgtctctaagtttaccgtgggctacgttaccggtaccggggtacggttcccggggtcccctacggaaccgtacttacgacggttcggacgtacggtccgggttcggtacgggaacctaggttaacctttccgaaccgtttctaccgtaaccaacttacaaaccgacggttcccgtaggaccgtacggtacgtaggtaacgggtaagttcgggtaacggtacgtttaagttttaacgttacgttacggtacgtaacggttaacgtaaggtttaaactttaaccgttaaacgttacccgttaccccggttaaccgggttaccgggttttaaccccgggaaaccgggttaaaaccgggggtaacccggttaaacggggtaacgttaaaaacgtaacccggtaaaaaacggtaccggttaggttaccgggtacgtaccggtaacccgttaaccgtaagtttaacccgttcgtttaccgtttaccgttaccgtttaccccgttaccccggttaccttaccgtttcgttaaaccgg

SEQ ID NO: 169918 - DNA, 691 bp, Homo sapiens
  misc_feature: GYAE6OF02F23BU.37.11.A11.1.454.CMB.1.raw
  modified_base (306)..(306): a, c, t, g, unknown or other
  misc_feature (306)..(306): n is a, c, g, or t
  modified_base (530)..(530): a, c, t, g, unknown or other
  misc_feature (530)..(530): n is a, c, g, or t
  modified_base (652)..(652): a, c, t, g, unknown or other
  misc_feature (652)..(652): n is a, c, g, or t
  modified_base (667)..(667): a, c, t, g, unknown or other
  misc_feature (667)..(667): n is a, c, g, or t
tcagtagtgtagatcacgaccggtgctcgatttagctacgactgcaggggcagcaagatggtgttgcagacccaggtcttcatttctactgttgctctggatctcgtggtcgccgtacgggacaccgtgatcgacccagtcctccagtacctccctggctgtgtctcgtgggcgaggacggtccctaccgatacctaacgtcgaccaagtccagaccaagtacgtttagtttaacacagtcctaacaaactaaataacgtaacgttacttagtcgttaggtaactacgagacgtaacggaaaccgnggacacgtacctacctaaactcgactaccgtaagtttacgcggtactacgtacccggtacccggggtacgtcccgggtacctacggtacctagtttaccggaggtcggtaccgtacgggtccgggttaccgagggtaacctaggtttaaccgttacccgacttaccgtacccgaactaacgttaccgaactccggtacgtgacgtagccgtaggaacggttacngggtacgtaacgttagtttacacgttgactagactattaactaactaacgtcctacggtaccgtacgtaacggacgtaaagacgtaagtacaactaacgacgtaagtgccgagtacgactancgtcgtattaccgtntaccgtacctccattactagtacg

SEQ ID NO: 169919 - DNA, 688 bp, Homo sapiens
  misc_feature: GYAE6OF02HQVQY.37.11.A11.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
tcagtagtgtagatcacgaccggtgctcgatttagctacgactgcagggggcagcaagatgggtgttgcagacccaggtcttcatttctctgttgctcgtggatctctggtgcctacggggacaccgtgatgacccagtctccagactccctggctgtgtctctggcgagaggcctcatcaactgcaagtccagccagacttgttttanacagcctaccaaacaataagaactacttagcttggtatcagcaagaaaccagggacagcctacctaaactgacttacaatttacgngggactataccgtaacccggggtagtaccggggtccctaggacccgtattccgaggtcggcgacggcgggtctgggacagtatttcgacttacgtcacctataccaaacgacgccctaggactaggggcctaggaaggtacgttaggtacgggtacttaacgttttaacgtacgttacggtaccgaaggtacctaaggttaacttttaaagtaaacttaccttcccgtaccggttaaccggtttccggaacccgggtaaacgggtaaccgtaaagggttacggaaaacgttcgaaacggtaccgtaacgtcggtacggtacctcggaccgtaaccgtaagttccgttacgttacttaccgaactttaccccgttacccgacccgtattacccg

SEQ ID NO: 169920 - DNA, 818 bp, Homo sapiens
  misc_feature: GYAE6OF02IJX3Q.37.11.A11.1.454.CMB.1.raw
  modified_base (207)..(207): a, c, t, g, unknown or other
  misc_feature (207)..(207): n is a, c, g, or t
  modified_base (320)..(320): a, c, t, g, unknown or other
  misc_feature (320)..(320): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagactgttttanacagctcaaacaataagaactacttagcttggtactcagcaagaaaccgagggcacgcctaccgtaaatcgactctatttacgtggggacctacgtaccggtaaccccggggnggttacccggggtccctgaacccgtagtttccgaggttacggacctacgggtcgggtaccgtcgggaactagtactttccacttacgttaccaacctaagtaccgtaaaccgtacgtacccgtacgtaccggtaacggtcccgttacgggtaaagggtcgttacgggtacggggttaacctttaaacgttttaacgttacccggttacggttaacccgtaaggttaaaccgtttaaacggttaaacgtttaaaaccttaaaccgtttacccgttaacccggttacccgggttaaaccggttttaacccgggaaaccggtaaaacgggggtaaccgttaaaacggggttaaacgtaaaaccggtaaacgtaaaaaccgggttaacgttcgggtacggacctttaacgggaacccttaaccggtactttaccggttacgtttaacccgttaccgtaactttaccccggttacccctaacccggtattaccccggttaaag

SEQ ID NO: 169921 - DNA, 804 bp, Homo sapiens
  misc_feature: GYAE6OF02FX0NO.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggagggcctccatcaactgcaagtccagccagacttgttttactacagcctaccaaacaataacgaacttacttagcttaggtatcagacaacgaaaccgagggcacgacctacctaaactcgtctactatttacgtcggctagtccgtacccggggtacggttcccggggtaccctaggaacccgtagttccgaggtcggacgaggtccgggtcgtacgggaactagttacgtttaccacgttacctaccgtaacctaactaccgaaacctacggacccgtacggaccgtacgggtcgttaacgggtagggtaacgttcgggtacgggttacgttaacgtttttaacgttacgttacggtacgtacgttaacgttaacgtttaactttaaacgttaaccttacccgtttacccgttacccgggttaccggttacccgggtaacccggtaaaccggggtaaccgttaacggggttaaacggttaaaaccgtaaacccggttaaaaccggtaaacgttcgggttaaccggtacgtacggtaacccgtaaccgttaaccgttacgtttacccgtttaccgtttaccgtaccgttttccccgttaacccggtaccctttaacggtaccctttaaaccgg

SEQ ID NO: 169922 - DNA, 808 bp, Homo sapiens
  misc_feature: GYAE6OF02I3EZ8.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatcgaccagtctccagactccctggctgtgtctcgtggcgagacgggcctccatcaactgcaacgtccagccaagtacttgttttaactacacgtcctacccaaactaaataaacgtaaaccttacgtttaacgtccgtttagggtactacgaacggtaccgaaacgaaaaccgaggggaccaacggaccccttaaccctaaaaaccttgacccttacgttaagtttttaccggtgggtaccgtaacgttcccggtaacccgggggtaccgggttaccccggggtacccgtacgtaccggtaacgttccgaacgggtcggtacggacgggtccggggtcggtacgggactaggttaacctttcgacctctacccaaccgtactaccaacgacggtacctcggacgtacggtcgtacgggaaggtggttcggtacggtactttaacgttttacgttaacgttcggtactaacggtacttaaagtttattaaaccttaagtttccccgttacccgtacccgggttacgttacccgggaacggtaaaacccgggaacggttaacgggtaaactaaacggtacctaaaagggtaccgttgggtacgtaccgttacgaacccggtccttacttccgttaagttccccttgttaacccttcccgttacccggaccttaagttcctacg

SEQ ID NO: 169923 - DNA, 723 bp, Homo sapiens
  misc_feature: GYAE6OF02IJPFE.37.11.A11.1.454.CMB.1.raw
  modified_base (207)..(207): a, c, t, g, unknown or other
  misc_feature (207)..(207): n is a, c, g, or t
  modified_base (682)..(682): a, c, t, g, unknown or other
  misc_feature (682)..(682): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctccagactccctggctgtgtctcgtggcgagaggcctccatcaactgcaagtccagccagtactgttttanacagcctaccaaactaaactaagaacttacttacgcgtttaggtattacgagacgaaacgaaaccgtaggggaccaaccgtcctaacctaaacgtcgaccttacgtaacttttaacgcggggtacctaacgttaccggtaaccccggggtacggttaccccggggtcccctacggaacccgtagtttaccggaacggttcgggacgtacgggtccgggttacgtacggggtaactacggtttaactttccgaccgttctaccctaacctaacgtacgtaaacgaccgtccgtacggaccgtaagggtcttagggaacgtacgttcggtaggtaccgtttagtttaacgtcgtagttacgaacggtcttaagttaacttaaagtaccttaccgtccgttaccggtacggttccggaacgaacgggtaccaagggtacgtaaatacgaaacgtgtacgtacggtctacgtctaccgnttacgttactcgtaacgtcttcgtccgtactccgtataccg

SEQ ID NO: 169924 - DNA, 749 bp, Homo sapiens
  misc_feature: GYAE6OF02HCQ07.37.11.A11.1.454.CMB.1.raw
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagacctccctggctgtgtctcgtgggcgaggacgggcctccatcaactgacaacgtccagccagtacttgtttatacagcctaccaaacaaataacgaaccttacttagtacttaggtactacagacaacgaaaccgaggaccacgtaccctacctaaacgtcgaccttactaattttacggttcgggacctacgttaccccgggtaaccccgggggtaccgggttccccgggggtacccgtacggtaaccgtacgttaccggacggtcgggtacgtacggggtccgggtaccggtagggtaactaggttacttaccacgtcctaccaacctactaccaaacgacgtcctcgacgacggacgtagggacggtagttacggtacggtacgttacgttttaacgtacgttacggacgtaggttacttaagttaacttaacttaacgttaccctccgtacggttaccgtaccgggaaccggaacgggtaacgacgggtaaagtaacgtaacgaaacggtacgtggtaccgtacgacgtaccgtactacgttcgttacgttaccttaccgttaaccgtttcccgttaccccgtacttacgtaccgttaaccg

SEQ ID NO: 169925 - DNA, 700 bp, Homo sapiens
  misc_feature: GYAE6OF02GU2ME.37.11.A11.1.454.CMB.1.raw
  modified_base (308)..(308): a, c, t, g, unknown or other
  misc_feature (308)..(308): n is a, c, g, or t
  modified_base (694)..(694): a, c, t, g, unknown or other
  misc_feature (694)..(694): n is a, c, g, or t
tcagtagtgtagatcacgaccggtgctcgatttagctacgactgcaggggcagcaagatggtgttgcatacccaggtcttcatttctctgttgctctggatctctggtgcctacggggacaccgtgatgacccagtctccagactccctggctgtgtctcgtgggcgagacggcctccatcaactgcaagtccagccagacttgttttatacagtcctaccaaacaaataaacgaacttacttaacgtcttaggtatcagccaagaaaaccgagggaccacgccttacctaaactgctctatttacgnggacagtccggtacccgggcggtcccgggtcctaggacctattcgaggtcggcgacgggtcggtcgtagggactagtactttaccaacttctaccgaacctagtacccaaacgacgtccctacggacctaagggtccgtaaggacggtaagttgggtcggtaaccgtttaagtttacttacgttggtacgaagttcctaaagtttaactttaataacccgttaccttacccgtaccgtaccggtttaccgggaaccgtaaacgggtaccggtaaaggttaacgtaaaacgtaaccgtaaaacgggtaccttaggtacgtacctacggaaccctacgtaacttcgtccgttaccttattacccgttcccttacccggactttacgtntaaccg

SEQ ID NO: 169926 - DNA, 702 bp, Homo sapiens
  misc_feature: GYAE6OF02GYRTF.37.11.A11.1.454.CMB.1.raw
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (425)..(425): a, c, t, g, unknown or other
  misc_feature (425)..(425): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctcgtgggcgaggagggcctccatcaactgacaagtccagccagtacttgttttanacngcctacaaacaataagaactacttagcttggtatcagcaagaaaccgaggcacgtcctaacctaaactcgtactactaacgttttacgcggggctacgttaccggtaaccccggggtcggttaccccggggtccctacggaccgtattacgaggtcggcgacggtcggtcgtagggactagtacttcgactcacaactataccgaacncgtctacgacgaggtctaggaggtagttggtacggtactttaagtttacgttacgtagtacgacgtactaagttaattaactaacgttaccgttacccgttaccggtaaccggtttaccggaaccggtaaacgggtaaccgtaaacgggttaacgaaaaccttaaaccgtaaaacggtaacgttcgtacgggtacccgtagtaaccctaacgttcgtaccgtttcgtttacgttaccttaacgttccccgttaccccggacttacgttacgttaacg

SEQ ID NO: 169927 - DNA, 643 bp, Homo sapiens
  misc_feature: GYAE6OF02GDHV8.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagtactgttttanacagctaccaacaataagaactacttagcttaggtatcagcaagaaaccagggcagcctactaaacctgctcagtttacgtgggacacgtcgtaccggggacgttcccggggtccctaggaccgtattcgaggttggccaggtccgggtctgggacagtactttaccacttcacaccatacaacagcctgcaggctgaggatggtggtacgttatttattactgtacagtctagttaattaattaactaccttaccgtaccgtaccggttaccggacccgtaaaggggtaacccgtaaggggttaacggtaaaagtaaccgtaaaacggtaaccgttgggtacgtaccgtacggaaccctaaccgtacgttcgttacggttaccctttaccgtaacctttccccgttaccccgaccttaaccgttccttaacgg

SEQ ID NO: 169928 - DNA, 703 bp, Homo sapiens
  misc_feature: GYAE6OF02IJUYX.37.11.A11.1.454.CMB.1.raw
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctcgtgggcgaggacgggcctccatcaactgcaagtccagccagtacttgttttanacngctaccaaacaaataacgaactacttagacgttggtactcagcaagaaaccgagggccacgtcctacctaaactgtacctactatttacgngggactaacgtccggtacccggggtcgtacccggggtcctggaccgtattcgagtggacgaggtcggtcgtggactagtacttccgacttacttccaacctacttaaccaacgtacgcccgttagcgacggtacgtggtaacggtagttcggtacggtacgttaacgttttacttacgttagttacgacgtacgtaagttacgttaattaacgttacccgtaccgttaccggttaccggttaccggtaccggtaaacgggtaaccggtaaacgggtaaggtaaaccgtaacgtaaacgtaacgtcggtacggtcgtacggtactaacccgtacgttcgttacgtccgttttttacgacctttacccgtaccccgtacctacgttaccgttaaccg

SEQ ID NO: 169929 - DNA, 704 bp, Homo sapiens
  misc_feature: GYAE6OF02GDYTI.37.11.A11.1.454.CMB.1.raw
  modified_base (278)..(278): a, c, t, g, unknown or other
  misc_feature (278)..(278): n is a, c, g, or t
  modified_base (310)..(310): a, c, t, g, unknown or other
  misc_feature (310)..(310): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggccctccatacaactgacaacgtccagccagtactttgttttatacagtcctaccaaacaaataacgaacttacttagcgttaggtatcagacaacgaaaccgnggcacgccctactaaactgactctatttacgnggactacgtaccggtacccggggtacggttccccggggtccctacggaccgtattacgaggtcggacgcggtcgggtcgtaggaactagtactttaccactacctacaacctactacgaaccacggacccgtgacgtacggcttagggaaggtacgttgggtacgggtactttaagtttttacgtacgttcggtaccgaggttacttaaagtttaacttaaacgtaacttacccgttaccgttacccggtaaccggttaccggaacccggtaaacggaacgttaacgggtaacgaaactacgaaacgtacgtggtacgaccgtacgtaccgtaacctagtttccgtacgtttacttaccgttaccttacccgtcccgacttacgtacttaaccg

SEQ ID NO: 169930 - DNA, 806 bp, Homo sapiens
  misc_feature: GYAE6OF02G7VR4.37.11.A11.1.454.CMB.1.raw
  modified_base (163)..(163): a, c, t, g, unknown or other
  misc_feature (163)..(163): n is a, c, g, or t
  modified_base (217)..(217): a, c, t, g, unknown or other
  misc_feature (217)..(217): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatgaccagtctccagacctcctggctgtgtctcgngggcgaggacggcctccagtcaactgcaacgtccagccgagtacttagttttanacacgcctaccaaacaaagtaaacgtaacttacgttaacgtcgtttaggtaacacgaacggacaaacgaaaccggtagggaccaacgcccttaactaaacgtcgtactactaacgttttacgcgggtctacgttaccggtacccggggaggttcccggtcccgtaagtacccgtattacgacggtcggacgacgggttccggtaggacggtaactacggtaactttccgactttactaccaactacctaacgaaacgcggttccacggtaccggaggacgttgggaacgggtagtttacgggtaggtaccgtttaattttaacgttacggtcggtacgtagttaacgtaagtttaaacttacgtaaactttacccgtaccggttacccgttacgggttcccggaaaccgggaaacggtaccggtaaacgggttaaacggtaaaccgtaaaaccggtaaaacgtacccgggttaaccgttacggggttaactccggtaaacccgtacgttaaccgtttacggttaccctttacggtttccctaacccgttcccggttttacccgtaacccggtcctttaagttaacccgg

SEQ ID NO: 169931 - DNA, 652 bp, Homo sapiens
  misc_feature: GYAE6OF02JSDZZ.37.11.A11.1.454.CMB.1.raw
  modified_base (215)..(215): a, c, t, g, unknown or other
  misc_feature (215)..(215): n is a, c, g, or t
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
  modified_base (498)..(498): a, c, t, g, unknown or other
  misc_feature (498)..(498): n is a, c, g, or t
  modified_base (578)..(578): a, c, t, g, unknown or other
  misc_feature (578)..(578): n is a, c, g, or t
  modified_base (606)..(606): a, c, t, g, unknown or other
  misc_feature (606)..(606): n is a, c, g, or t
  modified_base (637)..(637): a, c, t, g, unknown or other
  misc_feature (637)..(637): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtggcgagcggcctccatacgactgcaacgtccagtccagtacgttattttaanaccagtcctacccaaataaactaacgaacttacgtagtcttggtatcacggcaagaaaccagggcacggacccttactaaacctgtctactagtttaaccnggggtcctagtccgtaccggggtacggttccccggtccgtcgacccgttattcggaacgtcggacgtacggcgggtaccagggtanacggtttacttcaccgtcttaccaactgtacgcggaacttccgcgttacgcgtaggtacctagaacgtacgttgggtagtacgttaagtttcgttntcgtcgttcgacttacggtttacgttacgggtcctccgttaccgtccgggtaccgtacgggaccgaacgggtcgtaaggnggtaagtcccgaagccgtacgtagtcgngtacgcaactactcgtacttcggtccttacnccttccgtccgtacg

SEQ ID NO: 169932 - DNA, 756 bp, Homo sapiens
  misc_feature: GYAE6OF02GLXSS.37.11.A11.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctcagactcctggctgtgtctcgtgggcgagacgggcctccatcaactgcaagtccagccagtactgtttanacngctacaaacaaataagaactacttagtcttaggtaactcaagacaagtaaaaccgngggaccagacctacctaaaacgngtctactaatttacgnggtactacgttccgtaacccggggtacgtcccggggtaccctaggacccgtagttacgacggtacggacgtaacggtcgggtacgttacgggaactacggtactttaccaacgtcccgttaacaacctaacgttaaccaaacgtacgtaccgtacgtaacgtacggtcgtaaaggaggtacgtaggtacgggtaaccttaaattttaacgttacgtacgtaccgtaaggtaacgtaaagtttaacttaaacttaaaaccgtaccttccccggtaaccggtttaccggttaacccgggtaacccgtaaaacggggttaaaccaaaaggggtttaaccgaaaactttaaaccggaaaacgttaaccgtggttacgaccgtacgtaacctaccgtaacttccgtaattccgttacgttacgtccccgttaacccgtccttacgttacgtaacg

SEQ ID NO: 169933 - DNA, 619 bp, Homo sapiens
  misc_feature: GYAE6OF02FF6NY.37.11.A11.1.454.CMB.1.raw
  modified_base (210)..(210): a, c, t, g, unknown or other
  misc_feature (210)..(210): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctcatcaactgcaagtccagccagactgttttatacngctccaacaataagaactacttagcttggtatcagcagaaaccagggcagcctacctaaactgctcatttactgggcatcgtaccgggagtccggggtcctgaccgattcagtggcagcgggtctgggacagatttccactctcaccatacaacacgccctgcacggtctggaggtatggtggcgtattttacttacgtgtacagtcaaggttaattaactaacttacctcccgttaccggtaaccgttccgggacccgaaagggggtaacccgaaagggtttagggaaaactaaccggaaaaccgtaaccgttggttacggaccgtacggaccctaaccctagttaccttcggttaccttttacccgtaatttccccggtttacccccgccgtaacttccttaaaccg

SEQ ID NO: 169934 - DNA, 699 bp, Homo sapiens
  misc_feature: GYAE6OF02I3RU0.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcactgcagtccagccagacttgttttatacagcctaccaacaataacgaactacttagcttaggtatcagcaagaaccaggcagacctacctaaactgctactatttacgcgggtctacgtcgtaccccggggtacgtcccggggtcctagaccgtagttacgagtcggccgaggtccgggtctgggaactaggtactttccgaactcctacgacctatccaacacgcctgcgtagcgtagaggtagtcggtggtaccgttaattttacgttacgtgtaccgtaagtactaagttaatttaacgttaacttccgttaccccgtacggttacggtttacccggggaaaccgtaacggggtaaccgtaacggggttaacgtaaaacgttaacgtaaaaccgggttaacgttcgggttacgtaacccggttacggaaccctaccggttaaaccttcccgtttacgttacccgttttaccgaccgtttccccctttaacccggacccttacgttcccgttaaag

SEQ ID NO: 169935 - DNA, 900 bp, Homo sapiens
  misc_feature: GYAE6OF02GYLGK.37.11.A11.1.454.CMB.1.raw
  modified_base (86)..(86): a, c, t, g, unknown or other
  misc_feature (86)..(86): n is a, c, g, or t
tcagtagtgtagatcacgaccggtgctcgatttagctacgactgcaggggcagcaagatggtgttgcagacccaggtctcatttcnctgttgctctggatctcgtggtcgcctacgggacaccgtgactgacccagtctccagacctcctggctgtcgtctcgtggcgagacgggccttaccactaccaacgtgacctaacgtcccgagccgagtaccttggttttaacacgacgtacctaaccaaaacaaacgttaaacggaaccttaacgttaggtacgttacggtaacttcgacgtaacgaaaccgtaaaaccggtacgggacctaacgtaccccgtaaccttaaacgtcgtaccttaacgttacgtttaccgacgggtacctaccgttacccgggtacccgggtaccgggttacccgggtccctacggtaaccgtagttaccggaggtcggacgtacgggtccgggttagtaacggactacgttacgtttaccgacgttcctaaccgaacctacgtaacctaaccgtacgttaccgacgtacggccgggtacgacgggttaggtacgttcggtacgggttaacttaacggttttactacggtccgtacgtaacggttaccgttaagtttaaacgtttacgtaacccgtttaccgtaccccgttacgggttaacccgggtttaaccggaaaccgggtttaaaccggtaaggttaaaccggggtaacgttaaaaccccggttaaaccggaaaaacgttttacccgggtggtaaccccgggtttagaacccccggttaacgaaccccgggttttactaacccggttttacgtaaaccccgtttccccgttaccgtttaccccccggttacccgttcccttaaggttacccttaacccgg

SEQ ID NO: 169936 - DNA, 793 bp, Homo sapiens
  misc_feature: GYAE6OF02I1MYB.37.11.A11.1.454.CMB.1.raw
  modified_base (139)..(139): a, c, t, g, unknown or other
  misc_feature (139)..(139): n is a, c, g, or t
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (407)..(407): a, c, t, g, unknown or other
  misc_feature (407)..(407): n is a, c, g, or t
  modified_base (453)..(453): a, c, t, g, unknown or other
  misc_feature (453)..(453): n is a, c, g, or t
  modified_base (688)..(688): a, c, t, g, unknown or other
  misc_feature (688)..(688): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtcnccagacctcccgtggctgtgtctcgtgggcgaggacggcctcatacacgtgcaacgtcagccaagtacttgtttanacgagcctacaaacaataacgactacgttagacgttggtactacgagaccaaacggaaaccgnggacctacgacctaaccgtaagtcgtactacgtaacgtttcgcggactacgttcccggtaacccgggtacgttcccgggtcctacgacggtattcggaggtccgacggtacggtcggttacgacggtanaacgttcttaccactcgaacctcgtataaccgaacgtcacccggtnacggtacgtacgaggtacgtagtcggtacggtactttacgttacgtaactcggtacgtacgttaccgttaagttaagttaaacttaaccgttaccttacccgggttaccggtacggttaaccccgggtaaccggtaaaccggttaaacccggggaagtttaacccggaaaaccgttttaaacccggaaaaaccggtttacgggttacgggtacccggtacgggttttaaaccccncccggtaaacctttacgttaacccggtttacgttaccccgtttaccgtaacccgtttttaccccccgggaccctttaacgttcccgttaacgggtttaaacccgg

SEQ ID NO: 169937 - DNA, 745 bp, Homo sapiens
  misc_feature: GYAE6OF02JV4GL.37.11.A11.1.454.CMB.1.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctacgtgggcgaggagggcctccagtcaactgcaacgtccagccagtacttgttttanacagcctacaaacaataacgaactacttagcttggtatcagcagaaaccgnggacagtacctactaaacgtcgcctactactttacgtcggactacgtaccgtaccgggacggtcccgggtcctacgtaccgtacgtttacgaaggttcggaccgacggtaccgggtaccgtacgggaaccacggtttactttaccgtaccgttccgtacctaacccgtataccgaaaccgtccgtccggtacgacgacggtcgtacggaaggtggttacggcgtacggttaattttacgtacttcgtaccgaagttaccgttaaggtttaacttaacgtaacgtttacccgtaccggttacccgggtaaccgggtttacccggaaacccgggaacgggttaaacccggttaacgggttaaacgtaaaccgtaaacggtaaaccgtaacgtttccggacggtaccgtaaccgtacgtaaccgttagtaccgttcgttaccttacgtacccgttaccgtacccgtcctaagttaccgtacg

SEQ ID NO: 169938 - DNA, 796 bp, Homo sapiens
  misc_feature: GYAE6OF02GQKT9.37.11.A11.1.454.CMB.1.raw
  modified_base (209)..(209): a, c, t, g, unknown or other
  misc_feature (209)..(209): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagacctccctggctgtgtctctgggcgagagggcctcatcaactgcaagtccagccagacttgttttanacacgctaccaaacaataaagaacttacttagcttggtatcagcaagaaaccgagggccagtccctacctaaactcgacttctaatttacgtgggctacgtaccgtacccggggacggtcccgggtcctacggacccgtatttcgaggtcgggaccaggtccgggtctaggggaacctaaggtactttccgacttacctaccgaaccctaagtacccaaaccgtacggtcccttacgggaaccgtacgggtaccgttaggggaacgggtagttacggggttacgggtaaccgtttaaagtttttaccgttaaccggtttcggtaacccgtaagggtacgtaaaacggttttaactttaaaaccgttaaaacctttcccgttacccccgttaacccgggttaacccggggtttaccgggaaccccggtaaacgggggtaacccgttaaaggggttaacgtaaaaccgttaaccgtaaaaccggtaacgttacggtacggtaccgtaccggtacctaacccttacgttccgttacgttacctttaccttaccgttaccccgttaccccggtactacgttccttaaccgg

SEQ ID NO: 169939 - DNA, 851 bp, Homo sapiens
  misc_feature: GYAE6OF02IMJFO.37.11.A11.1.454.CMB.1.raw
  modified_base (208)..(208): a, c, t, g, unknown or other
  misc_feature (208)..(208): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatgaccagtctccagacctcctggctgtgtctcgtgggcgagcgggcctcatcactgcaacgtccagccagtacttgtttanacacgcctaccaaacgtaaataaacggtaaccttagttacggtacgtttacggtaacttcgaaggaccaaacggtaaaacccggaggggacctaaccgaccccttaaaccgttaaaacgtcggtaccgttacttaagttttaccgcggggtacctaacgtttaccccgggaaccccggggttaccggttccccgggggttacccctaacggtaacccgttacgttaaaccgggtaccggttacgggcccgtaacggggttccggggttacgtacgggtaacctagggtaccttttacgaaccgttccgtacctaaacctacgttaaccgaaaccgtaccggtcccgttaacggaccggtacgggtacgttagggacgggttaaggttcgggtaacggtacgtttaacgtttaacgttaccgtggtacgtaacggtacgttaagttaaccttattaaaccgttccgtaccggttacccgtaaccgggttaccgaacccgggttaacggtaaccggtaaggtaaccgggtaaacctaacgtaaaccggtactaccgggtacgtacgtaccggtaacgttacgtccgttaacgtttaccgtacgtaccgtttacccggtacccggtcctaagttacctaggtaacc

SEQ ID NO: 169940 - DNA, 762 bp, Homo sapiens
  misc_feature: GYAE6OF02JYPK5.37.11.A11.1.454.CMB.1.raw
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
  modified_base (544)..(544): a, c, t, g, unknown or other
  misc_feature (544)..(544): n is a, c, g, or t
  modified_base (598)..(598): a, c, t, g, unknown or other
  misc_feature (598)..(598): n is a, c, g, or t
tcagtagtgtagatcacgaccggtgctcgatttagctacgactgcagggcagcaagatggtgttgcagacccaggtcttcatttctctgttgctctggatctctggtgcctcgggacaccgtgatcgacccagtctaccacgactccccgtggcctgtcgtctcgtcgggacgaggacgggtccctccgacttccaacgtggtaccaaacgttcccgaacgcccgtaaggtaccttaggtttttaacgaaccacgtcctaacccgaaaacaaaaaggttaacgaaaacccttattacgggtcctttaagggtactaccgtagacctaaacgtaaaaccgnggggtacctacggtacccctaactaaaccncggtactacctaagtttacggcggtcctaacgttcccggtaacccggggtaaccggttcccggggtaccccttaggaacccgttgttaccgagggttcgcggtaacggtcgggttacccgagggacctagtaccgtttacgacctctacgactactacgaacgtactccgtagngtacggaccttaaggacgtattcgggagtaccgttagtttacggtactaccgtnaacggtcgtataaattacgtataccgtccgtcgtaaccggtcgaacccggaataaccggtagtaacgggtaaactaccggaaattaccgtgggacttcgaccgtccgtaacgtcttaccgtagttacccgattcccgtaacgttccgaaccttcacgttaaccg

SEQ ID NO: 169941 - DNA, 743 bp, Homo sapiens
  misc_feature: GYAE6OF02H93FF.37.11.A11.1.454.CMB.1.raw
  modified_base (548)..(548): a, c, t, g, unknown or other
  misc_feature (548)..(548): n is a, c, g, or t
  modified_base (741)..(741): a, c, t, g, unknown or other
  misc_feature (741)..(741): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacctagtcctccacgacctcccgtggtctgtcgtcgtcgtgggacggaggaccgggtccctaccatacaacgtgacaacgtaccacgaccgagttactttagttttatacgacgtaccctaaccaaactaaaataaacgtaaccttacgttacgtagttacggtatacgagaaccgaacgaaaccggaggaccacgtaccctaactaacctcgtaccttacgttaagtttacggcggtactaccggttacccgggtacccggggtaccggttacccgggtcctacggtaccgttacgtacgtagggtccggtacggacgggtccgggtacggtaggtaccgtagttacccgttacaccgtacctaccaacctcgtaaccaacgtccgccgtagacggtacggtagtaggacggttntcgggtcgtaactttattacgttacgtagtacgaattacgttaattacgttaacttaacctcccttaccgggtacgtaaccggtacgggaccaaaccgggagtaaggttaacgaacctaaacggaatacggtcgtacgaccgtcgactagtccttactacgttacctacgtccttcccgacctacttacgtanac

SEQ ID NO: 169942 - DNA, 924 bp, Homo sapiens
  misc_feature: GYAE6OF02GNB5D.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgccgtacgggacaccgtgatcgacccagtctccagtcctcctggctagtgtctacgtggcgaggacggcctacgactacgaactcgactaaacgtcgacggtccgtagtttacgttttaacaaccaactacgaaagtaacttaacggtacgtttctttaacggtctttacgggtaacccagaccgaaaggtaaaaccccacgaccgtacgtacccctaacgttaacgtccgttacgtacccgtttaccgtttaccggcggtaacccgttacccggtaacccggggtaaccgttccccgggggttaccctaacggtaacgtaacgtttcccgtaaggggttaccgggcccggggtttacgggttaccggtaacggggtaaccccttaaggtttacctttacccggtaaacccctttccgtaaacccgacttaccgtacggaaccaaccgggttacgtcccggggtacggtacccggggtacgtttaaagggtaaaccggttcggttccggggttttaacggggtttaccgtttttaaacgttttccggaaccggttacggtaacgttacgtttaaacgggttttattaccgggttttaccttaaaccgtttccgtaccgtttaaaccggttttcggttaacccgggaacgggtaacccggttaaaccggacggttacggtaccgggtaaagtccgtaaccggttaccgacgttaaacgtcggagttacccgtcgtacgtaccgttacgttacttcccggttacctacgttacccggttaccccttcggtaaccttaggtccggtattaacccgttacg

SEQ ID NO: 169943 - DNA, 645 bp, Homo sapiens
  misc_feature: GYAE6OF02HN36A.37.11.A11.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatgacccagtctccagactccctggctgtgtctctggcgagagggcctccatcaactcgcaagtccagcccagactgtttanacagcctaccaanaaataacgaactacttagcttggtatcancagaaacccagggcaggccctaccgtaaactgcctcatttactgggcagtcctacccgggacgtccgggtccctgaccgnttcagtgcaggcggtctggacngactttcgactctcaccagtcaacgagtcctgcgtagcgtagacggattcggtggacgtattttaagttcctacggttccaacggccgttaagttacgttaacttaaacgtacccttaccgttaccccgtagggtttacccggacccgtaaacgggggacctaacgggtaagtaaaacgtaaccgaaaaccgtaacgttaggacgtccgttacgaccgtacctaacgtactttacccggttactttaccgttacgtccccgttttacccgaccccgttaacgtccgttaaccg

SEQ ID NO: 169944 - DNA, 703 bp, Homo sapiens
  misc_feature: GYAE6OF02GFZ3I.37.11.A11.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (290)..(290): a, c, t, g, unknown or other
  misc_feature (290)..(290): n is a, c, g, or t
  modified_base (401)..(401): a, c, t, g, unknown or other
  misc_feature (401)..(401): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggaggcctccatcaactgcaacgtccagccagactgtttttanacagctaccaanaaataagaactacttagcttgtatcagcaagaaccaggcacgcctactaaactgctactatttacgnggctacgtccgtacccgggtcggtcccggggtcctggaccgtattcgagtcggcgacggcgggtccgttaggaactagtacttccgtactcctacaccgtactaccaaacncgtacctcgacgacggtcgtaggagggtacgttgggtcggtacgtttaattttacgttaaccgttcgtacgtacgtaaccgttaagttaactttaagttaacttacccgttaccggtttacccgtaaccgggtttaccgggaacccggtaaacggggtaaccgtaaacggggttaaggtaaaacctaacggtaaaacgtaacgtcgggtacggtcgttacggaacctaaccgtacgtttaccgtacggtttcccttaccgttaccgtttaccccttacccgacccgttaccttacgtaacgg

SEQ ID NO: 169945 - DNA, 931 bp, Homo sapiens
  misc_feature: GYAE6OF02HOFRL.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacgggacaccgtgatgacccagtctccagacctccctggctgtgtctcgtgggacgaaggacggtccctactactaccaactggaccgtaacgtccaacgacccgaagttacctttagtttttaacgaactacggtaccctaacctaaaaacgaaaacttaaacgtaacctttaacgttaacggtcgtttagggttaactactaacggaccgtaaaacggaaaacccggacgggacctaaccggtcccttaaaccgttaaaccgttcgaccttacgttaaacgtttttacgggacgggtacctaccgttaccccgggtaacccgggggtaccggttacccgggtccctacgggtaaccgttacgtttacgaacgggttccgggtacgtaacggggtccgggttacggtaacgggaaccgttacgttacgtttcccaaccgttcccgtaacctaaccgtactaaccgaacgtaccggtaccttcgggacgtaacgggtaccgtacggggtacgtacgttacgggttaccgggtaactttttaagtttaaaccgttacgggtagttaaaccggtacgttaacgttttaaagttaaactttttaaacgaacccgttttacctaacccccggtttaccgggtacccgggtttaaccgggaaaacccgggttaaaccggggtaaacggttaaaccgggtaacgtaaaaccgtaaaccaacgggttaactttcgggactaccggtttacgacctacctaccgggttattaccgttacctttacggtaccctaccccggtttacgccctttaagtcccgttaacg

SEQ ID NO: 169946 - DNA, 849 bp, Homo sapiens
  misc_feature: GYAE6OF02IDKFY.37.11.A11.1.454.CMB.1.raw
tcagtagtgtagatcacgaccggtgctcgatttagctacgactgcaggggcagcaagatgggtgttgcagacccaggtcttcatttctctgttgctctggatctctggtgccgtacggggacaccgtgatcgacccagtctaccagacctcccgtggctgtgtcctcgtgggcgaggacgggccctcctatcaaactggacaacgtccgacgccagtacttgttttaacacgagcctaccaaactaaataacgtaacttacttacgtcgttaggtactacagaccaaacggaaaccgacgggacaccgtacctacctaaactcgactactagtttacgcgggactacgttaccggtacccgggtaccggttcccggggtaccctacggaaccgttacgttaccgagggttaccgggacgtacggggtaccggggttcggtacgggtaacgttaacggttactttacccaaccgtttacctacctaaccgtaacttaaccaaccgtacgtacccgtacgacgacggtacggtcggaagggttaacgttgggtaacggttaaccgtttaagttttaaccggtttacgtacgggttacgtaaacggtaccgtttaaaggttttaaacttaaacccgtttaactacccggtttacccgtacccgggttaaccgggttaacccgggaacccggtaacgggtaaaccggtaagggttaaacgtaaacgttaaaccgaaaccggttaacgttacgggtacgtaccgttaccggaaactacccggttactttaccgttcttaacccgttttcgtacccgtttacccggtacccctaccgtaccttaccgttaaccgg

SEQ ID NO: 169947 - DNA, 747 bp, Homo sapiens
  misc_feature: GYAE6OF02F8HLI.37.11.A11.1.454.CMB.1.raw
  modified_base (206)..(206): a, c, t, g, unknown or other
  misc_feature (206)..(206): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagaggcctccatcaactgcaagtccagccagactgtttanacagctaccaacaataagaactacttagcttggtatcagacaacgaaaccgagggcacgaccctacctaaacgtgctacatttacgtgggactactaccgtacccgggacggttcccggggtcctgacccgtattcaaggtggacgtaggccgggtcgtacgggactaggtactttccgacttcgtaccaccgaataccgaaaccgacgtcccgtagaccgtaacgggtaccgtacgggtaagggtagtacgggttaccgggttagtttaacgtttttaaacgttaccgttacggttacccgtaaggtacctttaaagtttaatttaaacgttaaaccctttaccgttaccccgttacccggtaacccgggtttaccgggaacccggtaaaacggggtaacccgtaaaggggtacgtaaaacttacccgaaaaacggttacgttacggtacggaccgttacgtaccgaaccttacgttccgtacgttttcccttaccgttaaccgttccccgttacccgaccgtttaacctcgttaaaccg

SEQ ID NO: 169948 - DNA, 682 bp, Homo sapiens
  misc_feature: GYAE6OF02I8Y1B.37.11.A11.1.454.CMB.1.raw
  modified_base (439)..(439): a, c, t, g, unknown or other
  misc_feature (439)..(439): n is a, c, g, or t
  modified_base (490)..(490): a, c, t, g, unknown or other
  misc_feature (490)..(490): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctcgtgggcgagagggcctccatcaactgacaagtccacgccagtacttagtttatacacgactaccaaacaaactaagaacttacttagtcttaggtatcagacaagtaaaccgagggacacgacctacctaaactgtacttactaattttacgtcgggactacgttaccggtacccgggacggttccccggggtccctacggaaccgtacttacgaggtcggacgtaggccgggtcgtacgggactaagtacttacgactctacacctactacaaaccncgtacctgaccacggtctaggtagtcgtggtcgtacgttaattacttacgngtacacgtagtaattacttaacttaacgtaccgtccgttacccggtacgttaccgggaacccgtaaacgggtacgaacgggttaagtaaactaaccgaaaaccgtaacgtcggtaggttacacggacctaaccgtacttaccgtcttaccgttctaacccgtttccgttaccccacgttaccgtgttaaccg

SEQ ID NO: 169949 - DNA, 702 bp, Homo sapiens
  misc_feature: GYAE6OF02HLUAQ.37.11.A11.1.454.CMB.1.raw
  modified_base (163)..(163): a, c, t, g, unknown or other
  misc_feature (163)..(163): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (506)..(506): a, c, t, g, unknown or other
  misc_feature (506)..(506): n is a, c, g, or t
tcagtagtgtagatcacgaccggtgctcgatttagctacgactgcagggcagcaagatggtgttgcagacccaggtcttcatttctctgttgctctggatctctggtgccgtacggggacaccgtgatgacccagtcctccagacctcctggctgtgtctcgngggacgaggacgggtcctccatcaacgtgactaacgtccaagcccagtacttgttttaanacagtcctaccaaanaataacgaacttctagctagatcagacagaaaccaggactacgaccctacgtaaactcgtactacttagttacgcggactacgtccgtaacccgggtacgttcccggggtcccgtacgtaaccgttcgtacgacggttcggaccgtaggggtccgggttacgtacgggaacgtaacgtacgtttcaccgtttcacccgaactctaacgaaacgccgacgtgccgagtcgtagacggtagtcggtagtcgttaatttacgtactacgtnacggtaccttaggtaacttattaaacgtactacccgttagtacccggtttagacccgaaacggggttaaccgacgggttaagtaaaccggtaaactaaaccggtagttcgtcgagtaccggaacctaccggtaactcccgtttaagtccctttaacgtcccgtttcccgtaaccccgttccacgttaccttaaccg

SEQ ID NO: 169950 - DNA, 826 bp, Homo sapiens
  misc_feature: GYAE6OF02JPLS7.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacggccctcaactcaacgtgacaacgtccagaccagtacttgttttacacacgcctacaaacaaataacgtaaccttaacgttaagtacttaggtaactccaagacctaaacggaaaccgagggacaccggtaacccttaacctaaaacgtcgtacttaccgttaacgttttacgacggggtaccttaaccgttacccgggtaacccccggggttacgggttacccccggggttaccccttaaccgggtaaccccgtaagtttacccggtaagggtccgggtcgaacggggttccggggttaccggtacgggtaaccgtaacggttactttaccgaccttttaccgaccacctaaacgtaaccgaaaccgtcgtacccgtacggaccgtaggtccgtaggacggtacgtcggtacggtacttagtttacgttacgtcgtacaaggtacttaagttaacttaagttaacctccgtaccgttacggtaaccgttccggaaaccgtaacggaccggtaagtacggtaaactacggtaaaacccgtagttacggaccgtaacggttacgaaccgttaacccgttcggttacccgttaacgtttcccgttaacgtttaccccggttaccgttacccccggtacttaagttccccgtaaacg

SEQ ID NO: 169951 - DNA, 814 bp, Homo sapiens
  misc_feature: GYAE6OF02I8182.37.11.A11.1.454.CMB.1.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagacgggcctccatccaactgcaagtccagccagtacttgttttanacancctaccaactaaataagaacttaacttaagcgttaggtactcagcaagaaaccgagggcacgccgtacctaaacctcgtctacgtaatttttacgtgggggtacctacgtacccggttaacccccgggggtacggttaccccggggggttcccctacggtacccggtatttaaccgaggttacgggccgtaacggtcggggttccgtagggggaaccaggttaacgtttctaaccctttcgttaccacccgtaacgttacccgaaaacctaccggtaccgttacgggaccgtaggggtacccgtagggtaaagggttaacgttcgggttagggtaccggtttaaacgttttaacgtttaccgtacggttacgaagggttacctaaggtttaactttaaacggttaactttacccgttacccggtttacccgggttaacccggttacccgggtaaacccggtaaacggggtaaaccgtaacgggtaaacgggtaaactaacgtaaaaccggtaaccgttggtacggttacgtacggtaaccttaacgacctttcgttaaccgttctttactcttcccgtcccgtacctgtacttaacg

SEQ ID NO: 169952 - DNA, 845 bp, Homo sapiens
  misc_feature: GYAE6OF02HOB67.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccctggctgtgtctcgtgggcggaggacgggccctccatacaactgacctaacggtcccacgaccaagtactttagttttatacacgtacctaccaaactaaactaaacgtaaccttacgttagtcgttagtactacagacgaacgaaccgagggcaccgacctaccgtaactcgtactactacgttacgtcggactacgtcccggtacccgggtaccgggttcccggtcccgtacgtaccgtacgttacgtaggtcggacgtacgggtcggttcggtacggtaccgtacgttacgttacaccgttaccctacgtaacctactaaccgtacctacgtacccgtcggacgtaaccgggtgtaacggggtaaggtaccgttggggttacgggttaaccgttaacgtttttacgttaccggttacgtacggtaacgttacggtttagtttaacgtttaacgtaccctttacccgttaacccccggttaccggtttaacccgggttaacccgggaaccgggtaaaccggggtaaccggttaaacgggtaacgttaaaccttaaaccggaaacgggtttaccgtacgggtacccgttaccgtaaccgggtacccctaccgtttaacgttccgttttacccttacgtttacccccgttaaccgtttcccccggaaccccggtacctttacgtcccgttaaccg

SEQ ID NO: 169953 - DNA, 1032 bp, Homo sapiens
  misc_feature: GYAE6OF02FQMPC.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggactaccgtgatcgacccagtcctccagacctccctggctgtcgtctcgtgggcgagacgggcctccgatacaactgacaagtccaagccagtaccttgtttactacgacgtctaccgaacaataacgaacttacttagtccgttaggtactcaacgtccaaacggtaaaacccgaggggtaccaacggtaccccttaaccgtaaaaaccggttcgaacctttaccttaaaacgtttttaccggtaacgggggtaccttacggttaaccccggttaacccccggggggtacgggtttacccccgggggttacccccgttaagggtaacccccggttaaacgttttccggggaaccgggtttaaccggggccgttaacggggtacccggggggtttccttaccggggggaaaccctaacggggtttaacttttaaccccggaaccctttacccgttacctaaacccggtacttaacccggaaaaacccgtccgggttaccccagggtaccccggtaaaacggtccgttaaaggggaacggtaaccggtttggggtaaaccggttacccggtttaaaagtttttaaccgtttaaccccggtttgttaaacccggtaaggtttaacccgaagtttttaaaaccgggtttaaactttaaacccgggttacccctttaaccccgggtttacccgggttaaacccccgggttttaccgggggacccgtaaaaacccgggggttaccgtttaaaacggggtaacccgttaaaaaaggtaccccgtaaaaaggggtaaaccctttggggtttaccgacccgtttacgggttaaacccaaccgtccgtttaaccggtaccgttttacccgttacgtaaccccgtttccgttacccccggttaccctaagtttaccccggttaac

SEQ ID NO: 169954 - DNA, 865 bp, Homo sapiens
  misc_feature: GYAE6OF02JRMIH.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgcctacggggacaccgtgatgacccagtctccagactccctggctgtcgtctcgtgggcgaggaggcctccatacaactgcaacgtccagccagtactttgtttacacacgcctaacccaaactaaagtaacgtaaccttaacgtttacgcgttttaggtatccgaagaccgaaacgaaaccggaacgggcaaccgtaccccttaacctaaacctcgtacctacttaacgttttaccggtacgggactaaccggttccccgggtaaccccggggtaccgggttcccccggggttccgtaccggtaccgttacgttaccggtaagggtcggtaccggtacgggtcgggtaccggtggaaccgtaagttcgttaccgcttacctccgaaccttacaaccgtaccgtaaccgtcccgtaagtcgacggttaccgaggtaaggtccgtttagggtacgtacgtttaacgtttacttcggtaacgtaccgtaacggtatttaaaggttaactttaaacgttaacccgtacccgtttacccgggttaccggttccggttaaacccggtaccgtaaaacccggggttaaaccggtaacgggttaaaccgggtaaaacctaaaccccggttaaaacggttaccggtaacgggttccgtaacggttaacccggaaccttaacccgttcgttaacccgtttccgtttaccgtttacccgttaccggttttccccgtaaccccgtaccttaccgtttaccgtaaacccc

SEQ ID NO: 169955 - DNA, 658 bp, Homo sapiens
  misc_feature: GYAE6OF02GWVF2.37.11.A11.1.454.CMB.1.raw
  modified_base (210)..(210): a, c, t, g, unknown or other
  misc_feature (210)..(210): n is a, c, g, or t
  modified_base (264)..(264): a, c, t, g, unknown or other
  misc_feature (264)..(264): n is a, c, g, or t
  modified_base (411)..(411): a, c, t, g, unknown or other
  misc_feature (411)..(411): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgacaagtccagccagacttgttttanacagcctaccaaacaataagaacttacttagtcttggtatcagacaagaaaccngggacacgccctacctaaactgctactatttacgtgggcacgtccgtacccgggacggttcccggggtcctacggaccgtattcgaggtcggacgacggtcgggtcgtagggactaggtactttccgactctaccacactaccaacncgcctaggacaggacgtggacggtagtggtacggtagttaattttacttacgtcgtacagtcgtaagttaacttaataaccgttacctcccgttcggtaaccggttacccggaaccgtaacgggtacgtaagggtacgtaaactaccgaaaacggtaccgtaggtacgcctacggaccgtaaccttagttaccttcgttacccgtttaccggttacccgttccccgacctcttaccgttagtaaccc

SEQ ID NO: 169956 - DNA, 698 bp, Homo sapiens
  misc_feature: GYAE6OF02HLGWK.37.11.A11.1.454.CMB.1.raw
  modified_base (513)..(513): a, c, t, g, unknown or other
  misc_feature (513)..(513): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatgacccagtcctccagactcccgtggctgtgtctcgtagggcgagacgggcctaccatacaacgtggacaaacgtccgagccagtacttagtttttaacacacgtcctaccaaacgtaaataaacgaacttacgttagcttaggtactacagtacgaacgaaaccgagggactacggaccctaacctaaagtcgacttactacgtttacgcgggaactacgttacccggtacccggggtacggttccccggggtcctacgggaacccttagtccggaaggtcggaccgagggtccggtagtacgggactagttactttcgactaccgtaccactactaccaaacgcgctagcgtagcgtagagtgtggcgtacttatttacgtntcggtacagtacgtattaacgtatacgtactccgtacgtacggttaccgacgtaaacggacgtaggtaacgtaacgtaacaaacgttcgtcggtacgaccggtacgtaacccgtaaccgttacttaccgttacgttacccttaccgttaccgttccctaaccccggtctttaccgcgttaacccg

SEQ ID NO: 169957 - DNA, 735 bp, Homo sapiens
  misc_feature: GYAE6OF02GG46A.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggagggcctccatcaactgacaagtccagccagacttgttttatacagctaccaacaaataagaacttacttagtcgttaggtactacagacaacggaaaccgagggacacgtaccctacctaaactcgtctactaagtttaccgtggggacctacgttaccggtaccccggggtacggttccccgggggttacccctacggtacccgtattcgacggtcggacgacgggtccgggtcgtacgggactaagtactttcaccgttcctaccacctactaaccaaccgtacgtacccgtacggaccgaggtcgtaggaggtacgttggtcggtacgttaattttacgttacgtcgtacgtacgtacgtaagttacttactaactcccgttaccggttacccggtaccggttacccgggaaccggtaaaccggggtaaccgtaagggtaccgttaaactaacccggtaaaacgtacggttacggtacgtacgtacggtaccctaacctcgttacgttaccgttactttaccctccgtttacccgttacccgtaccgttacttactaacgg

SEQ ID NO: 169958 - DNA, 917 bp, Homo sapiens
  misc_feature: GYAE6OF02GLM9T.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagctcctggctgtcgtctcgtgggcgaggacgggccctccatcaactgacaacgtccacgaccagtactttgttttactacgacgtacctaccaaacaaataaacgtaaaccttacttacggtagttaggttacgtcagaccaaacggaaaccggacgggccaccggtcccctaacccgttaaactcgtaccttacgttactttacggtcgggacctaccgttaccccggtaacccgggggaccggggtttccccggggtccctacggtacccgttacgttaccggtacgggtacggtccgggtaacgggtcccggggttaccggttacgggtaaaccttacgggttaccttttacccgtaccgtccctacctacccgtaaatacccgtaaactacggtccccgtaggaccgtcgggggtactttaacggggacgggttttacgtcgggtttcggtaaaccgttttagttttaacgtttaccgtaacgggtcgtaagttacgtaagttttaacggttaaaccttaacccggtttcccctttaacccgggttacccgggttaacgtttaccccgggaaaccggtaaaccggggtaaacccggtaacgggttaaacgaaagttaaaccccggtaaacgttaacggtcggttaaccggtacccgtacggtaacccggtttaacccgttaattccccgtttacgggttttcccttaaacccgtttcccgttaacccccgggtttccccttaacccctaaccggttttccttaaacccggg

SEQ ID NO: 169959 - DNA, 778 bp, Homo sapiens
  misc_feature: GYAE6OF02GPQKO.37.11.A11.1.454.CMB.1.raw
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (379)..(379): a, c, t, g, unknown or other
  misc_feature (379)..(379): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatcgacccagtctccagacctccctggctgtgtctcgtgggcgaggacgggcctccatcaactgcaacgtccagccagtacttgttttactacacgctaccaaanaataaacgaactacttacgcttaggtatacacgtacgaagaaaccgngggaccacgtacctacctaaatcgacttactagttacgtcgggactacgtaccggtacccggggacggtccccggggtcctacggtaccgtcgttaccggngttcgggaccgtacgggtccgggtcgtacggggtactaagggttacctttccgaaccttcgtacccaacctacgtaaccaaacgtaccgtaccccgttaggaccgaacgggtcgtacgggaacggtacgttgggttacgtacgtttaattttacggaacgtttcgacgtacgtccgttaaagtttacttaaacgttaacttcccgtttacccggtacccggttaccggttacccgggtaacgtaaacccggggtaccggtaaaacgggttaacgaaaccttaaaccgaaaacgtcgtttacggtaccgttcgaacgtccgtaaccgttacgttaccgtttaccgtttaccgttccgttaaccgtttcccccgttacgtacccgttactaccgttaaacg

SEQ ID NO: 169960 - DNA, 806 bp, Homo sapiens
  misc_feature: GYAE6OF02I3YKH.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtggcgagagggcctccatcaagtgacaagtccagccagtacttgtttttaacacagtcctaccaaaacaaataaacgaaccttacgttagtcgttggtacttcgaagacgaacgaaaaccgcgggacaacggacccttaaccttaaaactggtacctaccttaacgtttttaccgtggggtaccttacggttaccccggttaacccggggtaccggggttcccggggttaccccgtacggtaaccgttacgtttaccgaacggggttcgggacgacgggttccggggttaccgtaggggtaacccagggttactttcccgaacgttcctaaccgaacctacgttaaccgaaaccgtacgcccggttagaccgacggtacctagggacggtacggttcggtacggtacgtttaacgttttaacgttacctaggtaccgaggttacgttacgttaaactttactaaaccttaccgttaccgttacccggtacggttaccgggaacccggtaagggaacccgttaaagggtacgtaaaaccgtaccggtaaacgtaacgtgtaccgggtcttacggaccgtaaccttattaccgttgtttacccttacgtaccgtttaccgtacccgtacgttacgtccgttaaccgg

SEQ ID NO: 169961 - DNA, 724 bp, Homo sapiens
  misc_feature: GYAE6OF02FV5YO.37.11.A11.1.454.CMB.1.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
tcagtagtgtagatcacgaccggtgctcgatttagctacgactgcaggggcagcaagatggtgttgcagacccaggtcttcatttctctgttgctctggatctctggtgcctacgggacaccgtgatgacccagtctcgagactccctggctgtgtctcgtgggcgagacggccttccatcaactgctaagtccagccagacttgttttanacngtctaccaaactaaataacgaacttacttagtcttaggtatcgagacaacgaaaccgagggtcacgtccctacctaaactcgaccttactaagtttacgtcgggtactacgtaccggtacccgggtacggttcccggggtacctcggtaccgtacgttacgtacggtcgacgtacggtcggtacgtaggactagtacgttcacgtctactacgtatacgactacgtcgtcgacgcggtacgtaggacgtcgtagggtcgtacgttacttttacgtacgtacgtacgtacgtagtaacgtttataacgtaacgttccgtacccgtaccggtaccggttaccggaccggtaaacgggtaacccgtaagggttaacgtaaccgttaaaccggaaacgtaaccggtttcggacggttacctacgggtaaccctaaccggtaccgttccggttaacgttcccgtttaaccgcccgttttacccgtaccccggtacttaacccgtcgttaaaccgg

SEQ ID NO: 169962 - DNA, 743 bp, Homo sapiens
  misc_feature: GYAE6OF02F1BO4.37.11.A11.1.454.CMB.1.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
tcagtagtgtagatcacgaccggtgctcgatttagctacgactgcagggggcagcaagatggtgttgcagacccaggtcttcatttctctgttgctctggatctctggtgcctacgggacaccgtgatgacccagtctccagactccgtggctgtgtctcgtgggcgaggacgggccctccataccaacgtgacaagtccagacctagtacttgttttaacacagtcctaccaaanaaataacgtaacttacgttagtctttaggtacacagacaaacgaaaccgagggaccaacgtacctaccgtaaactnaccttactagtttaccgacggtacctacgtacccggttacccggggtaccggttcccggggtccctaggtaccgtactttacggaggttcggcgtagggtcgggtacgtacgggaattcgtactttacctactaccttaccgaacctataccgaaacgtccgtacggcgtacgtacgagtaggtaacggtacgttacggtaggtacttacgtttaacgttacgtacggactacggtaatttacgttaattaaaccttaacgtaccttaccggtacggtaccgttaccggaacggtaacggtaaacggaacggttaaacgaaacgttaaacgaacgtaacggttaggccgtaaggtacctccgtaacttacgttaccgtttacctacgttaccttacccgttacccgtaccgaccgtttacacggttaaccc

SEQ ID NO: 169963 - DNA, 626 bp, Homo sapiens
  misc_feature: GYAE6OF02IT1LO.37.11.A11.1.454.CMB.1.raw
  modified_base (213)..(213): a, c, t, g, unknown or other
  misc_feature (213)..(213): n is a, c, g, or t
  modified_base (303)..(303): a, c, t, g, unknown or other
  misc_feature (303)..(303): n is a, c, g, or t
  modified_base (411)..(411): a, c, t, g, unknown or other
  misc_feature (411)..(411): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgaggagggccctccatcaactgcaagtccagccagtacttgtttttanacagcctaccaaacaataaagaacttacttagcttaggtatcagacaagaaaccagggcacgacctacctaaactgactctaatttacgngggcacgtccgtacccgggaggtcccgggtcctacggtaccgtattccgaggtcggacgacggtcgggtcgtgggactagtactttccactctacacctataccaacncgccctgcgaggcgtaggaggtagtggtggacgttaattttaatacgttagtcgagtactaagttattaataacttaccgtaccgttacgtaccggttccggaaccgtaacgggaaccgtaaaggtagtaaactacgaaaacgtacgtaggtacgactacgacctaacctattccttagttactacgtacttacccgtccccacttactactacg

SEQ ID NO: 169964 - DNA, 935 bp, Homo sapiens
  misc_feature: GYAE6OF02HHC85.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacaccgtggatcgacccagtctccagacctcccgtggctgtcgtctcgtgggacgaggaggcctaccatacaactgacctaacgtcccgagcctaagtacctttagtttttaacaacgacgtacctaacctaaaactaaaacgttaaacgtaaaaccgttacttttaacggtacgtttacggtaatcgaaacggaacaaacggtaaaaccggaggacctaacggtaccccttaaccgttaaaacttcggtcctttaaccttaagttttaccgcgggtaaccttaaccggtacccgggtttaaccccggggggacccgtttacccgggggtccccttaagggtaaccccgtttagtttacccggtaaggggttccgggtaccgttacggggttccggggtaacgggttaacgggaccgttaaacgtttacgtttaccgaccgtttacccgaccgtaaaaccttacggtaaccaaaccggtcgtccgttaggaccgtaacggggcttaggggacgtaacggtcggtaaccggttaccgtttaaatttaaccgttccgtttacggaccggttaaacgtaccggtttaatttaaaccgtttaaaacgttaacccgtttaccgtttaccccgggtaccggtttaaacccggttaccgggggaaacccggtaaacggggtaaaccgttaacgggggttaactaaacggtaaaccggtaaaacgtacgggttgggacgtttacgaccggaccaaccttagttccgtaacgttcccttaattacccttacccggttcccaacgtttaccgtacgtttaaaccg

SEQ ID NO: 169965 - DNA, 710 bp, Homo sapiens
  misc_feature: GYAE6OF02JSGDK.37.11.A11.1.454.CMB.1.raw
  modified_base (139)..(139): a, c, t, g, unknown or other
  misc_feature (139)..(139): n is a, c, g, or t
  modified_base (155)..(155): a, c, t, g, unknown or other
  misc_feature (155)..(155): n is a, c, g, or t
  modified_base (303)..(303): a, c, t, g, unknown or other
  misc_feature (303)..(303): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatcgaaaaacccngtctccagacctcccnggctgtgtctacgtgggcgacggacgggcctccatacaactcgacaacgtccagccagtacttacgtttacacacgtcctaaccaaacaaagtaacgtaaccttacgttacgtacgttacggtactacgtagacgtaacgaaaccggngggtaccacggtaccctaaccttaaactcgcttactatttacgcgggactacgtaccggtacccgggaggtccccggtacctcggactacgttcgtaggtcggacgtaccgggtcggtcgtacggtaactacgttaacttccgaccgttactacccgaacctagtaccacgtaccggtcgtcgacggtacgngttagngtagtcgtcgtacgttatttacgtactgtacgagtacttaagtcttaagtacttccgtaccgtcgttaccgtacgtaccggaacgtaaccggtaggaccgtaaacgtaccgtaaacgcggttcggacgtacgtacggaacccgtctacggttacgttcttacccgttacgttacccttaccctaccgtaccgttagttacccggtaaac

SEQ ID NO: 169966 - DNA, 846 bp, Homo sapiens
  misc_feature: GYAE6OF02I51VW.37.11.A11.1.454.CMB.1.raw
  modified_base (215)..(215): a, c, t, g, unknown or other
  misc_feature (215)..(215): n is a, c, g, or t
  modified_base (277)..(277): a, c, t, g, unknown or other
  misc_feature (277)..(277): n is a, c, g, or t
tcagtagtgtagatcacgaccggtgctcgatttagctacgactgcaggggcagcaagatggtgttgcagacccaggtcttcatttctctgttgctctggatctctggtgcctacggggacacgtgatgacccagtctccagacctccctggctgtgtctcgtgggcgaggacgggcctccatcaactgacaacgtccagccagacttgttttaanacacgcctaccaaacaaataacgaactacttagcgttggtatacagtacaacgtaaaaccgngggaccacggcccttaacctaaaactcgaccttactactttttaaccggtcgggactaaccttccggtaaccccgggggtagggtttcccccggggtacccctacgggaacccgttacgttaccgtaacgggttccgggaccgtaacggggtccgggggttaccggtacggggtaaaccgtaacgggtttaacctttttacccggtaaccctttacccgtaacccgtaaacccgtaaactttacccgaaaaacccgaccgggttaccccgttacggaccggtacgggggtaccgttagggtaacgggtacgttaggggttccgggtaacgtttaaccgtttttaagttaaccgttcggttaaccgttaggaacttaacggttaattaaccgttaaccttacccgttacccgttaccggttaccggttaccggaccggtaaaccgggtaacgtaaggtacgtaaactaccggaaacgtacgttcgggacgtacgtaccgtaaccgtacttaccgtcttaccgtttactaccgttacttacccccgtaccctagtttactaaccgttaacc

SEQ ID NO: 169967 - DNA, 586 bp, Homo sapiens
  misc_feature: GYAE6OF02FJJIP.37.11.A11.1.454.CMB.1.raw
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtagggcagacggccacgatcaactgcaagtccaggccggattcgtttacaccaactccaagaatacgngttcttagcttggaccagacaagaaaccncgacncgcctcagctgctcgtttacnggcctcgtaccggagtccggtctgaactntcagtggcgnggtcgaggacngtcttcactctcaaccntacagcacgctggccggctagaacgtgtggtcggtacgtttcttacgtcgtcagtctaagttaacttgtcgttaacctccgtacttacgttacggtttcggacccggtacggggtaacctaaggtcgtagggtaaacgcgtaccgtacgaaccgtagtcgtcgtactcgaccgtacctaacttcctacgttctccgtacgttccctacccgcgttaactcgtaacgtactaaccg

SEQ ID NO: 169968 - DNA, 746 bp, Homo sapiens
  misc_feature: GYAE6OF02F8OFE.37.11.A11.1.454.CMB.1.raw
  modified_base (216)..(216): a, c, t, g, unknown or other
  misc_feature (216)..(216): n is a, c, g, or t
  modified_base (430)..(430): a, c, t, g, unknown or other
  misc_feature (430)..(430): n is a, c, g, or t
tcagtagtgtagatcacgaccggtgctcgatttagctacgactgcaggggcagcaagatggtgttgcagacccaggtcttcatttctctgttgctctggatctctgtgcctacggggacacgtgatcgaccagtctcagactcctgctgtgtctcgtgggcgaggacgggcctaccgatacaactgctaagtccagccagactttgttttataacncgactaccaaacgtaaactaaacgaacttactacgtcttacggtatacagacaagaaaccgagggacacgtacctacgtaaactcgtactatacgttttacgtacggtctacgtaccggtacccgggtacggtcccggggtacctcgaccgtaagttcgacggtggcgtcggtacgggtcgtacggaacgtagtaacgttaccacgtttacccnccgttaaacattacccgaaaccaccgtcggtacgacgacggtacgacgggtaggacgtggttggtacgttacgtttaacgttactacggtactacggtaccgtaaggtttaacttaacgttaaacgttcccgttaccggttacccgtacgggtttaccggaaccggtaaaccgggaacccggtaaagggtaaccgtaaaccggtaaaccgtaaacggtaacgttaggttacgacttaccggaactaaccgttacggtccttacggttaccttacgttacctttcccgtaccccgttacgttaccttaccgttaacg

SEQ ID NO: 169969 - DNA, 814 bp, Homo sapiens
  misc_feature: GYAE6OF02GBR4N.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttaacacagcctaccaaactaaataaacgaacttacgttaagtcgtttaggtactcgagacgaacgaaaacccgaggggaccaacgtcccttaacctaaaactcggacctctaatttacgtcgggacctacgtaccggtaaccccggggacggttcccggggtcccctacggacccgtatttccgaagggttcggaccgagggtccggggttcgtacgggaacaaggttactttaccgacgttcctaccaaccgtataaccaaacgcgtaccgtacgacggtacgggtccgtaaggacggtagttacggggttacgggtaccgttttaaagttttaaccggtttaaccgtcggttaccgtaacggtacgttaaagtttaactttaacgttaaaaccttacccgtttacccgttaacccgggttaaccggttacccgggaaccggtaaaaccggggtaaccggtaaacggggttaaacgaaaacccgttaaaccgtaaaacggtaaccgttagggtaccggtcgtaacggtaccctaaccgttacgttaccgttacgtttaccgttacttaccgttccccttacccggaccttactaccgttaaaccg

SEQ ID NO: 169970 - DNA, 843 bp, Homo sapiens
  misc_feature: GYAE6OF02FM6XH.37.11.A11.1.454.CMB.1.raw
tcagtagtgtagatcacgaccggtgctcgatttagctacgactgcaggggcagcaagatggtgttgcagacccaggtcttcatttctctgtttgctctggatctctggtgccgtacggggacaccgtgatgaccctagtctccagactccctggctgtgtctcgtgggcggtaggacgggccctctagtccaaacgtgactaaacgtccgacgaccgtaacgtacttttgttttaactaacgtagacccttacccgaaaactaaaattaaacggtaaaccttaacctttaacgtccgtttagggttacttacgaacgtaccgaaacggtaaaaccgaacggacgacgacccttaacctaaactcgtacctcttaacgttaccgtgggacctacgtaccggtacccggggtaaccggttcccgggggtccgttacggaaccggtacttacggtacggtacgggtaccggtaaccggggtccgggttaccggtaacgggaacgtacgtttaacgtttaccgtaccggtaaccctaccaaccggtactaccctaaaccgtaacggttacccgtgaacccggtacggtaccgttgggtaaaccggtgtacggggttacgtacggttaattttacgttacttacgtacgtaagtacgtacgttaacttaagttaaccttacgttacccgtaccgtcccggtaacccgggtaccggtaaacggaaccggttaaggtaacggtaacctaaccgtaaaacggtacgtacggtacgcgtaccgtaactacggtaccggtcgttacgtcgtttaacctccgttacccgtaccgtaccgttagtacccgttacg

SEQ ID NO: 169971 - DNA, 718 bp, Homo sapiens
  misc_feature: GYAE6OF02GZ01Z.37.11.A11.1.454.CMB.1.raw
  modified_base (222)..(222): a, c, t, g, unknown or other
  misc_feature (222)..(222): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtgatcgacccagtcctccagcctcccgtggctgtgtctcgtgggcgaggaggccctcagtccaactcgactaacggtccaagccctaagtactttnttttaacgacacgtcctacctaaacaagtaaacgaacttacgttagcgttagttacactaagacgaacgtaaacgacgggacaccgactaaccgtaaactcgacttactagtttaaccggggacttcgtaccggtacccgggaggttccccggggtcctacggaacgttcgtaccgtaggtacggcgtacgggcggttcgacgggatagttcttacgacctcactacagtacaacggtcaccgtgacgtcgtactaggagtacgtgtcggtagttagttacttacggtacgtacaaggttccgtaaagttaacgttaactaacgttacccttacccgtaacgggttacccgtaaccgggtaacgaacggtaaccgggaaacggttaacgtaaaccggttaacaaaacggtgtacggtacgtagtaccgaacgtaaccttacttcggttacttccgtacgttaccgttcccggtacccttacctacgttacgtaacc

SEQ ID NO: 169972 - DNA, 669 bp, Homo sapiens
  misc_feature: GYAE6OF02H7BCJ.37.11.A11.1.454.CMB.1.raw
  modified_base (211)..(211): a, c, t, g, unknown or other
  misc_feature (211)..(211): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctccatcaactgcaagtccagccagtacttgttttanacgagcctaccaaacaataaacgaactacttagcttaggtatcagacagaaaccgagggcacgcctacctaaactcgctactactttacagggctacgttccgtacccgggcggttcccggggtaccctgaccgtattcgagtcggcgtaggcgggtcgtcgggaactaggtactttaccgacttcctacgacctactacaaactcgtaccgtgaccgaggtccgtaggtaaggtagttcgggtggtacgttagttttactacgttagtacgagtacgtagttaacgttaattaactacctaccgtacgttaccggttaccggaaccgaacgggtacgtaagggttaacgaagtaaccgaaacgttacgtacgtacgtactacggcctaaccttagttccgttacgttaccgtttacctacgtttaccccgttcccgtaacctagttacccgttaacg

SEQ ID NO: 169973 - DNA, 581 bp, Homo sapiens
  misc_feature: GYAE6OF02GO6TN.37.11.A11.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (553)..(553): a, c, t, g, unknown or other
  misc_feature (553)..(553): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaaanaataagaactacttagcttgatcagcaagaaaccngggcacgcctacaaacgtgctcatttacngggactactaccggtacccgggtacggttcccggggtcccctaggaccgtactttacgaaggtcggcgaggtcgggtacgtgggaacnggtaactttccacttcncaaccatcaacagtctagcaggctagacggtatgtggattatttacttactgtaccagtcaagttattaagtaactacctccgacgttacgtccgacgtaacgacgtaaggaagaactaacaaacgtagtgtcactcggactaacgacttcgttatccgttanccgttccgttcccgagttactcgtaacc

SEQ ID NO: 169974 - DNA, 832 bp, Homo sapiens
  misc_feature: GYAE6OF02FL6L3.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagacctccctggctgtgtctcgtgggcgaggacgggccctccataccaactgacaacgtccagccagtacttgttttacacgacgacctaccaaacaaataaacgtaacttacgttacgtattaggtactacacggggacaaaccgtaaacggacggacgtaccgtaccctaacccgttaaccgtcgtaccttacctttaacgtttacggtacggtaccgtaaccggttaccccggggtaccccggggttacccgggttacccccggggttaccccgtaacgggtaaccgttaccgttacgggtacggtccgggtaccggtaggggtcccgggtttaccggacgggtaactaccggtttactttacccgacctttcccaacccgtaacgtactaacccgacgtaccgtaccgtaggacgtaggaccgtagggaaggttacggtacgggtcgttacgtttaagtttaccgtatgtaaccgtgttaacggttaatttaaataacgtaacccgtttcctaccccggttacccggtaccggttacccggaaaccgggttaaaccgggaacgttaaagggtaaccttaaactaaaccgtaacgtagttccgggtagtcccgtacgccgtaacttcgtacgtttaccctacgtttacctacccgtttccccgtacccgtacttaccgtacgttaacc

SEQ ID NO: 169975 - DNA, 763 bp, Homo sapiens
  misc_feature: GYAE6OF02GB7DG.37.11.A11.1.454.CMB.1.raw
  modified_base (217)..(217): a, c, t, g, unknown or other
  misc_feature (217)..(217): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatccaactgacaagtccacgccaagtcttagttttanacagcctaccaacaataacgtaacttacgttagtccgtttaggtaactcgaagtaccgaaagaaaccgacgggaccacgtaccccttaacctaaactcgtactaccttaagttaccgtggacctacgttaccggtaccccggggtacggttcccggggtcctacggaccgtacgttacgagtcggcgacggtccgggtacgttacgggactaagttaccttccgacgttcacaccgtaactaccaaacgcgtcctacggcgtaacggcgtaacgggtagggtacttacgggttcggtaactttaagtttaccgttactacgggtactacgttacgttaaagtttaagttaacttaaccgtttaccgttacccgtaacccgggtttacccggtccgggaacccggtaaagggtaccggtaaagggttaacggtaaaactaaccggaaaaccgtacgttggtaccgaactacccggtataacccgttactaccggtttacgtccgtttacccgactttacccccgtaccgtaccttactacggttaac

SEQ ID NO: 169976 - DNA, 970 bp, Homo sapiens
  misc_feature: GYAE6OF02GK6Z7.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtcgccgtacggggacaccggtgatcgacccagtcctccagacctcccgtggtctgtgtctcgtgggcgaggacggcctccatacaactgacaacgtccacgaccagtacttagttttaacacacgtcctaccaaaacaaactaaacgtaaccttacgttaaggtcgttaggtaactacgaacgtaccgaaacggaaacccgggacggaccgtaccgtaaccccttaaccccttaaaaccgtcggtacctttaccgttaacgttttaaccggcgggggtaacccttaaccgggttaccccgggtaaacccccggggggtaccgggttacccccgggggtaccccgttaccgggtaacccggttaaccgttcggaccggggtaccgggtaccggtacggggtacccggggttacgggtaaccgggtaaccgttaacgggttacctttaccgaacccgtttacccgtacctaaacctaccgttaacccgaacgttacccggtaccgtaaccggaacggttccgggtaacgggtaagggtaacggttaacgggttcggggttaacggttaaccggtttaattttaaccggttaccggtaaccgtaacgtaaccgttaagtttaaccgttaaagtttaacctttaaacccgtaccccgtttaccccgggtaccgtttaacccggggtaacccggtaaaccgggtaaacggggttaaacccggttaaagggttaaaccgtaaacgtaaaccggtaaaccgtaacggttaccggtaggtacccgtaccgtaaaccgtaccgttacgttaccgttaccggttcctttaccgtacccgtttcccgtaccccgtaccttacgtacgttaacgg

SEQ ID NO: 169977 - DNA, 789 bp, Homo sapiens
  misc_feature: GYAE6OF02HOY8P.37.11.A11.1.454.CMB.1.raw
  modified_base (217)..(217): a, c, t, g, unknown or other
  misc_feature (217)..(217): n is a, c, g, or t
tcagtagtgtagatcacgaccggtgctcgatttagctacgactgcaggggcagcaagatggtgttgcagacccaggtcttcatttctctgttgctctggatctcgtggtgccgtacggggacaccgtgatgacccagtctccagacctccctggctgtgtcctcgtgggcgagacgggcctccatcaactgctaagtccagccagtacttgttttanacagtcctaccaaacaaataacgaaaccttacgttagtctttaggtactcagacaacgaaaccgagggacacgtacctacctaaactgaccttctaatttacgtcggtacctacgttacccggtaaccccggggtacgggttccccggggtaccttcggacccgttagtccgtaggtcggacgacggtccgggtcgtacgggactacgttactttccgacctttcctaccgaacctactaccaaaacgtcgtaccgtgaccgaggacgtacggtaggtacgtgggtacgggttacttaagttttacgttacttgtaccgtaacgtacgttaaagttaagtttaaacttaaccgtttacccgttacccgtaccgggttacccggtttaaccgggtacccgggtaaaacgggtaacccggtaaaggggttaaccgtaaaacggttaaacccgtaaaacgggttaccgttacgggtcggtaaccttaccgggtaacccgacgttaacctccgtttcccgttacctttaccctaccggtttcccctcccgggtacccttacggttacgttaacccg

SEQ ID NO: 169978 - DNA, 625 bp, Homo sapiens
  misc_feature: GYAE6OF02FW1LT.37.11.A11.1.454.CMB.1.raw
  modified_base (261)..(261): a, c, t, g, unknown or other
  misc_feature (261)..(261): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgagagggcctcatcaactgacaagtccagccagacttgttttatacacgctaccaacaataagaactacttagcttggtatacagacagaaaccngggacagcctacctaaactgctactatttacgtgggcatccgtacccgggacgttcccggggtcctcggaccgtacttcgaggtcggtcgacggtcgggtacgtagggacacgtacgtttcacttcctacaccgactacgaaacacgcctagcgaggtcaggacggtatcggtggtacgtattttactacgtgtacagtactagttattaactaacttacctacccgttaccgtaccggttacgacccgaacgggaaccgtaagggtacgtaaacgtacaaaccgtacgttacggtggactacgccaacctagttcgtacggttaccttacgtacctttcccgtacccgtacctacttctaacg

SEQ ID NO: 169979 - DNA, 889 bp, Homo sapiens
  misc_feature: GYAE6OF02GB854.37.11.A11.1.454.CMB.1.raw
  modified_base (109)..(109): a, c, t, g, unknown or other
  misc_feature (109)..(109): n is a, c, g, or t
  modified_base (217)..(217): a, c, t, g, unknown or other
  misc_feature (217)..(217): n is a, c, g, or t
tcagtagtgtagatcacgaccggtgctcgatttagctacgactgcaggggcagcaagatggtgttgcagacccaggtcttcatttctctgttgctctggatctctggtncctacggggacaccgtgatgacccagtctccagacctccctggctgtgtcctcgtgggcgagacgggcctccatcaacgtgcaacgtccagccagacttgtttacacncgactaccaaacaaataacgaacttacttagcgttaggtactcgacggaccaaagaaaacccggaggggaccacggtcccctaaccctaaacgtcgtaccttaaccttaaccttttaccggtaggggaccctacgtttaccccgggtaaccccggggtaccgtaccgggtttaccccccggggggttcccccgttaacgggtaaccccggttacgttccgtaaaccgggccccgggtacggacgggggtaccggggttcggtaccggggaacggttaacgttaccgtttaccgtaacccttacccttaccgaacccgtaccttaaccggaccggtacgtaccgggtaccgtcgggaaccgtaacgggtaccggttacggaaacggtacggtacgggtttacggttaccggtttaacggtttttacgttttcgttacggtttcggttcgttaacggttacgggtttttaacggttttccggggttacctttaccccggggtttacgtcccgggttttcgggaacccgggtcgggttaaccggggaccgggtaagggttggaaacggtaacgtaccggtacggtaacggtacggtacggttacgggtcccgtacgtaccgtaccgtacgtttccgttacggtttcccttacgttaccccgttccgttacccccg

SEQ ID NO: 169980 - DNA, 745 bp, Homo sapiens
  misc_feature: GYAE6OF02JI188.37.11.A11.1.454.CMB.1.raw
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
  modified_base (561)..(561): a, c, t, g, unknown or other
  misc_feature (561)..(561): n is a, c, g, or t
  modified_base (671)..(671): a, c, t, g, unknown or other
  misc_feature (671)..(671): n is a, c, g, or t
tcagtagtgtagatcacgaccggtgctcgatttagctacgactgcagggcagcaagatggtgttgcagacccaggtcttcatttctctgttgctctggatctctggtgccgtacggggacaccgtgatgacccagtctccagacctccctggctgtgtctcgtgggcgagacgggccctccatcaactgacaaacgtccacgaccagtacctttgtttttaacaccgaacgaccccccaaataaactaaaacgtaaaccttaaccgtttacggtaccgttttagggtaactaccgaacggaccaaacggaaaaccggaacggggtacaccggtaccccttaacccgttaaaactccggtaccttaccgttaatttaccggtcggggtactaaccgttacccggttaaccccggggtaacggttccccggggttaccctaccggtaccgtattcgacggtcgacgcgggtacggtcgtggactagtactttccaccgttcactacnctacaacgtcnctacgcgacgcgtaggacgtgagtggtacgttatttacgtactanacgagattaagttattaacgttaacttccgtaccgtccggttaaccggccggtaaccgaacgggtaccgtaaaggtacgtaaactaaccggaaacgttacgtgtaccgtnacccgtaccgtaacctcttacgtcgtttacctatacccgtttaccgtccctaccgttacgttcctaagtaaccg

SEQ ID NO: 169981 - DNA, 779 bp, Homo sapiens
  misc_feature: GYAE6OF02F4VA9.37.11.A11.1.454.CMB.1.raw
  modified_base (87)..(87): a, c, t, g, unknown or other
  misc_feature (87)..(87): n is a, c, g, or t
  modified_base (254)..(254): a, c, t, g, unknown or other
  misc_feature (254)..(254): n is a, c, g, or t
  modified_base (383)..(383): a, c, t, g, unknown or other
  misc_feature (383)..(383): n is a, c, g, or t
  modified_base (766)..(766): a, c, t, g, unknown or other
  misc_feature (766)..(766): n is a, c, g, or t
tcagtagtgtagatcacgaccggtgctcgatttagctacgactgcaggggcagcaagatggtgttgcagacccaggtcttcatttcnctgttgctctggatctctggtcgccgtaacggggacaccgtgactcgacccagtcctccagacctcccgtggctgtgtctcgtagggcgaggacgggcctaccattacgaacctcgacaacggtccacggccaagtactttgttttaacacgacgtcctacctaaanaaacgtaacgaaccttacctagtcgtttaggtatacacgaccgaacgtaaccgcgggtacacgtaccctaacgttaacgcgtactacttatttaacggcgggtactaccggttccggtaaccccggggnggtttaccccggggaccttacgggacccgtaagttaccggtggtaccggcgtacgggtccgggggttaccttcggggaacttacggtaacgtttcccaccgttccgttaacccaactacgtaaccgaacttacggtccaacgggtcgaacggttccggaggtagtacgggttggtacgttacgttaacgttttactaccgttgtaccgtacgttacgttagttaacttaactacgtttacccgtaccgtaccggtaaccgggtacggacggtaacggaccggttaaggtaaccggaaactaacggtaaaccgacgttcggaacgttccgacggccctaccgtacttacttccgttaccctcgttaacccttcccggaaccctntacccgtagttac

SEQ ID NO: 169982 - DNA, 877 bp, Homo sapiens
  misc_feature: GYAE6OF02GS3H9.37.11.A11.1.454.CMB.1.raw
  modified_base (216)..(216): a, c, t, g, unknown or other
  misc_feature (216)..(216): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatacaactcgacacgtccagccagtacttgttttanacagtcctaccaacaaataaacgaaccttacttagtacttaggtactacacgacaacgaaccgaggacacgtacctacctaaacgcgtactactactttaccggcggtactacgtccggtaccgggtacgtcccgtacgggtccctcgaccgtagtcgacggtcggcgtacgggtcggtcgtacggggactagttaccgtttcaccctccgtacctaaccgaacttaccgaaccacggtcccgtacgggacctacgggtaccgtagggtaacggtaacgtttggggtaaaccggttcgttttaacgtttaacgttcccgggttaacggtaaccgtaacggtttacccttaaaagggttttaactttaaaacccgtttaaaaccccgttttccccggttacccgggtttaaacccccggggtttacccggtttaaaccccggggtaaaccccggggttaaaacccggggttaaacccgggtaaaaaggggttaaacccggttaaacccggtaaaaaccgggtaaccccggttaacgggttgggtaaccggtcccggtttaaacacccccggtaaaccggtttacgtttacccggtttaccgttacccgtttaaccgtaccccgtttaaccccggttcccctaccccgttaacggttaacccg

SEQ ID NO: 169983 - DNA, 685 bp, Homo sapiens
  misc_feature: GYAE6OF02FUY68.37.11.A11.1.454.CMB.1.raw
  modified_base (167)..(167): a, c, t, g, unknown or other
  misc_feature (167)..(167): n is a, c, g, or t
  modified_base (379)..(379): a, c, t, g, unknown or other
  misc_feature (379)..(379): n is a, c, g, or t
  modified_base (432)..(432): a, c, t, g, unknown or other
  misc_feature (432)..(432): n is a, c, g, or t
  modified_base (641)..(641): a, c, t, g, unknown or other
  misc_feature (641)..(641): n is a, c, g, or t
tcagtagtgtagatcacgaccggtgctcgatttagctacgactgcaggggcagcaagatggtgttgcagacccaggtcttcattttctctgttgctctggatctctgtgcctacggggacaccgtgatgacccagtctcagactcctggctgtgtctctggggcagnggcctcatcaactgcaagtcagccagactgtttactacagctaccaacgaatagtaactacttgtccgtttgtactcagcaagaaccaagggcacgtcctacctaaactgactcatttactgggcatacgttacccgggagtcccgggtaccttacggaccgacttctaggtcggcgagcggggtacgtgggacgacgtatttccgttaccncgttaccactataccgaaacctacggcccagcgtaacgggcttcgggaggtanggttcgggtaaccgtacgttttaacgtttacgtacgttaccgttaacggaactacggtttaaatttaacttaaactttacccgttaccctacccggtttaacgggtcccgggttaacccgaacgggggtaaaccctaacgggggttaacggaaacttaaccggaacgtaacccggtaggttcgaccgtcgtaacaccgaacttccgttntaccgttcgtaactttccccgtccgtcccgtattacccgtaacg

SEQ ID NO: 169984 - DNA, 752 bp, Homo sapiens
  misc_feature: GYAE6OF02HU9S0.37.11.A11.1.454.CMB.1.raw
  modified_base (740)..(740): a, c, t, g, unknown or other
  misc_feature (740)..(740): n is a, c, g, or t
  modified_base (747)..(747): a, c, t, g, unknown or other
  misc_feature (747)..(747): n is a, c, g, or t
tcagtagtgtagatcacgaccggtgctcgatttagctacgactgcaggggcagcaagatggtgttgcagacccaggtcttcatttctctgttgctctggatctctggtgccgtacgggacaccgtgatcgacccagtcctccagacctcccgtgctgtgtctcgtgggacgagacggccctcatacactgactaacgtccagccagtacttagttttacactacgacctaccaaactaaataaacgtaacttacttacgtcttagtatacacgacgaacgaaaccgaggaccactaccctactaagtcgtctacgtatttacgtcggactacgttacccggtaacccggggtccggttccccgggtacctacggtaacccgttacgttcgtacgggtcggacgtacgggtccgggtacgtacgggtactagtactttaccaccttccgtaccaacgactaaccaaacgcgtccgtacggaccggtacggtcgtagggtacgtaggttcggtacggttacgtttaatttaccgttactcgtacgtacgttacgttaaacgtttacttaacgttaacgtttaccgttacccggttaacccggttaccgggttaacccgggaacccgggtaaacgggtaaacggtaacggttaaaccgaaaaccgtacgtaaaacgtacgttacggtacggctaccgacctaccgttcgtacttccgttaccttaccgtccttcccgtacccngttactntaacc

SEQ ID NO: 169985 - DNA, 634 bp, Homo sapiens
  misc_feature: GYAE6OF02F6SJ3.37.11.A11.1.454.CMB.1.raw
  modified_base (213)..(213): a, c, t, g, unknown or other
  misc_feature (213)..(213): n is a, c, g, or t
  modified_base (288)..(288): a, c, t, g, unknown or other
  misc_feature (288)..(288): n is a, c, g, or t
tcagtagtgtagatcacgaccggtgctcgatttagctacgactgcagggggcagcaagatggtgttgcagacccaggtcttcatttctctgttgctctggatctctggtgcctacggggacaccgtgatgacccagtctccagactccctggctgtgtctctgggcgagagggcctccatcaactgccaagtccagccagactgttttatacngctaccaacaataagaactacttagcttggtatcagcaagaaaccaggcagcctacctaaactgctacatttacnggcatcgtaccgggagtccgggtcctggccgtattcacggtggacgaggccgggtcgtgggacacggtatttcactctcaccatacagtcacgcctgacgaggctacgaagacgttgtagggtactagttttactttcgttgttacgttgacttaggtttacgttttacggggttaacctttccgggttaccgggttacccgtttaccgggtcgggtaccggtaacggggtaacccggtaaaggggttaacggaacgggtaactaccggaacggtacggtaacgtcgggttacggctcggtaaccactacgttcgtacgttctttcgaccgttcctacccgtaccg

SEQ ID NO: 169986 - DNA, 777 bp, Homo sapiens
  misc_feature: GYAE6OF02HA4SI.37.11.A11.1.454.CMB.1.raw
  modified_base (486)..(486): a, c, t, g, unknown or other
  misc_feature (486)..(486): n is a, c, g, or t
tcagtagtgtagatcacgaccggtgctcgatttagctacgactgcaggggcagcaagatggtgttgcagacccaggtcttcatttctctgttgctctggatctctggtcgcgtacggggacaccgtgatgaccacgtctcagacctccgtggctgtgtctaaaaacgtgggacggaggacgggtcctacctactacaacgtacgacgaacgtaccacggaccacggtacgtttagttttaacctaagacgtacctaaccaaacaaattaaacggaaacttactacgtagttagtacctagacgacgaacgaaacggaggacgacgtacctacctaaagtcactaccgtagttaccgtaggtactaacgtaccggtaaccgggtaaccggtcccggttaccgtacgtaccgtacgttacgagtacggacggaacgggtcgggtcggacggtacgaacgttacgttaccaactcgtacctaaccgtanaaccgtaacgtacgacgtaccgtagaggtacgtacggaggtacgttggtacggttacgttaagtttacgtacgttaagtgaacggttataacgttaattaacgttaccgtaaccgtccgtaacgtacccggttaacggaacccgtaacgggtaaacgtacggtaaacgaaaccgtaaacgtaaacggtaaacgttccggaggtaaccggtacctaacggtaacctacggttacgtacctttcggtttaaccttcgttaaacccggtcctaaaccgttacctacgtaaccgg

SEQ ID NO: 169987 - DNA, 811 bp, Homo sapiens
  misc_feature: GYAE6OF02I5QN4.37.11.A11.1.454.CMB.1.raw
  modified_base (217)..(217): a, c, t, g, unknown or other
  misc_feature (217)..(217): n is a, c, g, or t
  modified_base (496)..(496): a, c, t, g, unknown or other
  misc_feature (496)..(496): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctcgtgggcgaggacgggcctccatcaacgtgcaaggtccagccaagtacttgttttaanacgagcctaccaaactaaataacgaaacttaacttagcttaggtaatcgagacaagaaaacccgtagggcctaacgccctacctaaaacgtcgtacctacctaagtttttaccgagggtacctacgttacccgggtaacccggggtaccgggttcccggggttaccctaacgtaccggtaacttcggtaaaccgggtgtaaccggtgggttaccgggtagtaccgggtaacgtagttaaccttaccgtaccgtacctaccaaactacctaccgtaaacnccggtccgtaacgggcgtaaggaccggtaggtaacggtaggttacggttacgggtacgttagtttaaacgttctacggtaaccgtaaggtaaccttaaagttacgttaaacttaacgtttaccccgttaaccccgttaccgggttaaccggttacccgggtaaccggtaaccggggtaaaccggtaaagggtaacgtaaaaccggtaaccgtaaaaccgtacgttacggtacgacgtaccgtaaccgtaaccgtactaacgtttaccgtacttactacccgttaccgtaccgtacccggtactaccggttaaccg

SEQ ID NO: 169988 - DNA, 692 bp, Homo sapiens
  misc_feature: GYAE6OF02FJX95.37.11.A11.1.454.CMB.1.raw
  modified_base (309)..(309): a, c, t, g, unknown or other
  misc_feature (309)..(309): n is a, c, g, or t
tcagtagtgtagatcacgaccggtgctcgatttagctacgactgcagggggcagcaagatggtgttgcagacccaggtcttcatttctctgttgctctggatctctggtgcctacgggacaccgtgatgacccagtctccagactcctggctgtgtctctgggcgagagggcctccatcaactgacaacgtccacgtccagactgtttacacgagtctaccaataacgttaagaactaactttagcgtttaggtattcagcgaagaaaccgtagggcacgccctactaaactgtacctctactttacgnggacctataccgtacccgggtgtcccggggtccctaggtaccctacgttcgacggtcggtacgacggtcgggtcagggtactaagggtctttccgacttcctacgacctacgtccaaacgccgtccttcgacgaggtcctagggagtaacgtggtacggacgttaagttttaacgttacgttcgtaacgtagacgtttaaggttatttaagtaaacttaaccttccgttaccgtaaccggtttaccgggttacccgaaacggggtaaccctaagggggttaactaaaacgtacgtaaacgtaactacggttaccggacgtaccgtaaccgtactaacgttcgtacgttaccttctacgtcccgttcccgaccttcgtcgtaac

SEQ ID NO: 169989 - DNA, 752 bp, Homo sapiens
  misc_feature: GYAE6OF02HEDUL.37.11.A11.1.454.CMB.1.raw
  modified_base (156)..(156): a, c, t, g, unknown or other
  misc_feature (156)..(156): n is a, c, g, or t
  modified_base (510)..(510): a, c, t, g, unknown or other
  misc_feature (510)..(510): n is a, c, g, or t
tcagtagtgtagatcacgaccggtgctcgatttagctacgactgcaggggcagcaagatggtgttgcagacccaggtcttcatttctctgttgctctggatctctggtcgaccgtacgggacaccgtgatcgaccctagtcctccagtcctcccgnggtcctgtcgtcttcgagggcgaggtcggccctaccataccaacgtcgaccgtaacgtccgacggcctaagttacctttaggtttaacacgtaccgtacctaacaaaactaaacgtaacgtaacttacgtacgtagttacggtacaccgaagaaccggaacgtaaaccggcggtacctaccgaccccttaataacgcttacctacttacgtggacgactaccggttacccggccgggtaccggccggtacctgacgtactaggaggtccgaggtccgggtcgtaggaacggtaatcgttaacgtccctatacccgaacgaccttacgaccaaccggtcgtcggagtaaccgggngtacgtacgggagtaggtacgtacggttacttacgtttacgtaccgtacgtacgtaacgttactttaaggtaacttacgtaccgttaccgtcccggtaaccggttacggtaacccgtaacggtaccgtaaagaccgtaaagtaaccgaaacgtaactacggtgtaccgtacgtacgtccttacggtaccttcggtacctttaccgtaccgttcccgtacctacccgtactacttctaacccg

SEQ ID NO: 169990 - DNA, 816 bp, Homo sapiens
  misc_feature: GYAE6OF02IMWYU.37.11.A11.1.454.CMB.1.raw
  modified_base (222)..(222): a, c, t, g, unknown or other
  misc_feature (222)..(222): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccgtggctgtgtctcgtgggcgaggacggtcctccatccaactgacaacgtccagcccagtactttgttttaanacgacgacctaccaaactaaagtaaacgaacttaacgttacgtcgtttaggtactacgacgaacgtaaacggaaacccgaacggggtacctacggaccccttaaaccgttaaacgttcgtaccttaccgttaagtttttaccggcgggtacctaacggttacccggtaacccgggggtaccggttaccccggggtaccctacggtaaccgtactttacgaagggtccggacgtacgggtccgggttacggtacgggtaacgtacggttaccttttccgaccgtttaccgtcccgtaacctaactaaccgaaaccgtacgtcccgtagccgtacggtacgtaggtacggtaggttcggtacggttacgtttaactttaacggtcttacggtacgaacgttacgtatttaattaaccgttacttacccgtaccgttacccgtacggttaaccggaaccggtaaaggtacccggtaaggtaaaccgttaaacgtaaccggaaacgttacggttaaggcggttaaactcggaccttaacctcgttaccttcgttaccttcgtacccgttacccgtacccttactccgttacgttaacg

SEQ ID NO: 169991 - DNA, 766 bp, Homo sapiens
  misc_feature: GYAE6OF02JT6BV.37.11.A11.1.454.CMB.1.raw
  modified_base (443)..(443): a, c, t, g, unknown or other
  misc_feature (443)..(443): n is a, c, g, or t
  modified_base (724)..(724): a, c, t, g, unknown or other
  misc_feature (724)..(724): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagcctccctggctgtgtctcgtgggcgagtacggcctccatccaacgtcgcaagtcccgacgacccagtacctttagttttacacgacgtcctaccaaactaaagtaaacgtaaccttacgttaagcgtttaggtactcgaacggacaaacggaaaccgagggactaccgcccgttacctaaactcgtactcgtaagttcgagggctacgtcccggtaccgggtaccggtcccgggtacctggacctgttacgaggttcggcgtacggtcgggtcgtacggacgtacgtactttcctaaccnccgttacacctaattaaccgaacgttccgtaccgtacgcgtacggggctacgggaaggttcggtacgggtcgtaccgttaatttaccggttacctgtaccgacgtacgtttaaaggtactttaaggtaacccttccggttaccccggttaacgggttccccgggtttaaccggaccgttaaacggggtaaccggaaagtttaaccgggaaagttacccggaaaacgtacggttactccgggaactttaccgaccgtaccctaaggtttcctaaccggtttntaccccgtacgttacccgttccgtaccctagttacccttaag

SEQ ID NO: 169992 - DNA, 792 bp, Homo sapiens
  misc_feature: GYAE6OF02HYJNK.37.11.A11.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctcagactccctgctgtgtctcgtggcgagaggcctcatcaactgcaagtccagccagattgttttanacagtctacaanaataaacgtaactacttagcttaggtatcagacaagaaaaccgngggtacagtacccttacctaaacgtgtcctactaacgtttacgtagggctaacgttccggtaccccggggaggttccccggggtaccctacggacccgtattaccgaggtccggaccgtagggtccgggttacgagggtaactaggttactttcgacctctaccaaccgtatacctaaacgacgtccgtagcgtacggtacgtacggtacgtaggttggtacgggtacgtttaactttttaacgtaccggttgttaaccgacgttacgtaagtttaaactttaaacttaaaccgttacccttaccccgggttaccgttaaacccggtttacccggggaaacccgtaaacgggggtaaccgttaaacgggttaaaccggtaaaacggttaaacccgaaaccggttaaccgttacgggtacggtacccgtaaccgggtaaccctaaccttaccgtacgttttacccgtttacgtttacccgttaccggtttacccctttaaccccccggatttaaccccgttacgttaaaccgg

SEQ ID NO: 169993 - DNA, 673 bp, Homo sapiens
  misc_feature: GYAE6OF02JK294.37.11.A11.1.454.CMB.1.raw
  modified_base (214)..(214): a, c, t, g, unknown or other
  misc_feature (214)..(214): n is a, c, g, or t
  modified_base (306)..(306): a, c, t, g, unknown or other
  misc_feature (306)..(306): n is a, c, g, or t
  modified_base (604)..(604): a, c, t, g, unknown or other
  misc_feature (604)..(604): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagactccctggctgtgtctcgtgggcgagagggcctccatcaactgacaacgtccagccagtacttgttttanacacgtcctaccaaacaaagtaaacgtaaccttacttacggtctttaggtactcacgacaacgaaccgagggcacgacccttaccaaacgtnccttactacgtttacgtcggactacgtaccggtacccggggtacgggttcccgggtacctacggacccgtattcgaggtcggacgtcgggaccgggtcgtacggactagtactttaccgacttccgtaccaaccgtactaccaacgtacgtccgtacgcgtacgggcgtaggtaacggtagtgggtacgtaccgtttatttacgtacttcggtacacgttataatttataacgttactccgtccgtaccgtaccggttacgaaccgtaacggacgtaaggtataaactacgaaaccgngtcgtgtccacgtacctactacgtcgttagtaccctttactcccgttaccgtcccacttagtcctaacg

SEQ ID NO: 169994 - DNA, 799 bp, Homo sapiens
  misc_feature: GYAE6OF02IBG3K.37.11.A11.1.454.CMB.1.raw
  modified_base (141)..(141): a, c, t, g, unknown or other
  misc_feature (141)..(141): n is a, c, g, or t
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (427)..(427): a, c, t, g, unknown or other
  misc_feature (427)..(427): n is a, c, g, or t
tcagtagtgtagatcacgaccggtgctcgatttagctacgactgcaggggcagcaagatggtgttgcagacccaggtcttcatttctctgttgctctggatctcgtggtcgccgtacgggacaccgtgatcgaccagttcnccacgacctccnggtctcgtgtctcgtgggcgaggacggcctcactacaacncgactaacgtaccacaccgggggggtactcgtttaagtttaacacgactaccacctaaataaacgtaaagaaaccttaacttaggtaccttacggtaattacgaacgaaccaaacggaaacgtacggaccgacgtaacctaaccgttaacacgtactaaccgtacgttacggtaccggtactaaccggtaaccggttaccgggtacccgttccgggttacccaacgaccgttanacgtgtacgccggtaggcggttacgacggacgaagtttctacgcgtttacaacacctaacgtccaagtacgtccgtaacgcgtacgaggactaggttacgtaccggtaagtaccggtttatttaaacgtcgttacggaccttaggacttttaaggaaactttaacgtaagtttaccgacccgttacccgttaacggggacccgttaaacggaaccgggtaacggaaacgtttacgaaaacgaacgtaaaaccggttaagttacccgggttacggacgtaaacccggtacctaaactccccggttacttaacggtttccgttaaccggtacccctttaaccggccccgtttaacttaacggttactttaaacg

SEQ ID NO: 169995 - DNA, 709 bp, Homo sapiens
  misc_feature: GYAE6OF02H8UZO.37.11.A11.1.454.CMB.1.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
  modified_base (654)..(654): a, c, t, g, unknown or other
  misc_feature (654)..(654): n is a, c, g, or t
  modified_base (676)..(676): a, c, t, g, unknown or other
  misc_feature (676)..(676): n is a, c, g, or t
tcagtagtgtagatcacgaccggtgctcgatttagctacgactgcaggggcagcaagatggtgttgcagacccaggtcttcatttctctgttgctctggatctctggtcgcctacggggacaccgtgatcgacccagtctccagactccctggctgtgtctcgtgggcgagacgggtccctaccgatcaacgtgccaacgtccgagcccagtaccgtttcgttttaanaacgacgtcctacctaaacaaagttaaacgaactacttagnttaggtatctagacagaaaccagggacacgtaccgtacctaaactgaccgtactaacttttagcgggactacttaccggtaccgggacggtttcccggggtccctagggaccgttaacttcggacgttaggcctacgggtcggtaccgacggggtaacaaggttaacttccgtaccgtactaccgaacctcgtaacaacgttaaccnccggtgaccgnggtacgtaagacggtaggtacggttcggaaccggtttaatttaccgttagtacgactaacggtatacggttaataacgttactaaccgtctacggtaccgtacgtcgaaacggttacaagggttcgaaaactacgaaccgtatacggtagacccttggactaacctntaacccgttattacccggttanacctttaccctcccgtaacttactcttaaaccg

SEQ ID NO: 169996 - DNA, 967 bp, Homo sapiens
  misc_feature: GYAE6OF02FG19C.37.11.A11.1.454.CMB.1.raw
tcagtagtgtagatcacgaccggtgctcgatttagctacgactgcaggggcagcaagatggtgttgcagacccaggtcttcatttctctgttgctctggatctctggtgccgtacggggacaccgtgatgacccagtctccagaccttccctggctgtgtctcgtgggcgagacgggcctccatcaactgcaagtccagccagacttgttttaacaccgagcctaccaaactaaagtaacgtaacttacttacggcctttaggtactacgaacgcgaaacgaaacccgacggggaccaccggtaccccttaccgtaaaacgttcgccttaccttaagttttaccggtacgggacctaacggttacccggtaacccgggggtaggtttaccccggggtcccctacgggtaacccgtacgttacggtacggtcggggtacctacggggtccggggtttaccgtacggggtacctaacgggtttaccttttaccaacccttccggttaaccacccgtaaacttaacccgaaaacccggtcgggtaccccgttacgggaccgtaacggggtaccgttagggtaaacgggtaccggtttagggtaaccggggttaaccgttaaacgtttttaacccgtttaaacggttcggtaacccgttaacggttaaccggttaacggttttaaaagttaaaccggttaaaacctttccccgttaaccgggttaaccccgggttaaccgggttttaacccggggaaacccccgggtaaacgggggtaaaacccggttaaaacggggtttaaacgggtaaaaaccgttaaacccgggaaaaaccgggttaaccgtttaacgggggtacgtaccggttaaccggtcccgtaaacccgtaccgttttaccggtttacttacccgttttaccgtacccgtttacccccggttttacccgccgtttaaaccgcggtttaaacccg

SEQ ID NO: 169997 - DNA, 664 bp, Homo sapiens
  misc_feature: GYAE6OF02G771T.37.11.A11.1.454.CMB.1.raw
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaaacaataagaacttacttagcttggtactcgagcaagaaaccagggccacgccctacctaaactgccttactattttacngggctactaccgtaccccggggaggtcccggggttccctggaccgtattccgaggtcggacacgggtcgggtcgtagggacctaggtactttaccaccttcgtacctaaccctagttaccaaaccgtacgcccttagcgtacgggtcttagggacggtagttcgggtggtaccggttaattttacgttactaggtactagacttaaggttaatttaactaacttacccgttaccctccgggtaccggtttacgggacccgtaaggggtacccgtaagggtacgaaacgtacgaaacggtacgttggacgctagcctactactcgtcgttaccttgtaccgttccttacccggactagttctaacg

SEQ ID NO: 169998 - DNA, 767 bp, Homo sapiens
  misc_feature: GYAE6OF02GQDJ3.37.11.A11.1.454.CMB.1.raw
  modified_base (215)..(215): a, c, t, g, unknown or other
  misc_feature (215)..(215): n is a, c, g, or t
tcagtagtgtagatcacgaccggtgctcgatttagctacgactgcaggggcagcaagatggtgttgcagacccaggtcttcatttctctgttgctctggatctctggtgcctacggggacaccgtgatgacccagtctccagactccctggctgtcgtctcgtgggcgagacgggcctcatcaactgcaacgtccagccagtacttagtttttanaaccagtacctaccaaaactaaagtaaacgtaacttaaccttagtacgtttaggtaactacaagaccgaaaacggaaacccgaggggaccaacgtaccccttaaccttaaacgtcggtccttacttaacttttacgtgggacctacggtcccggtaacccggggtacggttccccggggtcctacggtaacgtacttaccgaggtcggacgcgggtccgggttcgtacgggaactaggttactttccgacttacccgtacaacccgtacgtaccaaaccgtcgtccgtacggtacgagggtccgtaggtaaggtcgtaggtggtacgttattttacgttacgtgtaccgagtacgtacgtttattaaacgtacgttaccgttaccgtaccggttaccggttaccggtaaccgaacggggtaaccgtaaaggtaccgtaaacctaccgaaaacgtaccgtgtacggtacgtaaccgtccgtaaccttcgttcttacggtttaccctaccgttccctttaacccgttaccccgttacttaccgtagttaacccg

SEQ ID NO: 169999 - DNA, 799 bp, Homo sapiens
  misc_feature: GYAE6OF02H9WZT.37.11.A11.1.454.CMB.1.raw
tcagtagtgtagatcacgaccggtgctcgatttagctacgactgcagggcagcaagatggtgttgcagacccaggtcttcatttctctgttgctctggatctctggtgccgtacggggacaccgtgatcgacccagtctccagaccttccctggctgtgtctcgtgggcgaggacggtcctcatcaacgtgactaacgtcgagacccagtactttgttttaatacgacgtacctaccaaaactaaattaaacgtaaccttaagtttacgtacgtttaggtaactacgagaaccgaacgaaaaccggcgggacaacgtcctaacctaaacgtcgtaccttacgttaacgtttacggcggtacgtaccgttacccggaacccggggtacggttcccgggtaccttacggaccgttacttcgacgggtcggaccgtagggtccggttcggacgggtacgtagttacttaccgtactccgtacaacctcgtaaccaacgtacgtccggtacgtacggtggtacgtaggtacggtagttcggtcggtaactttagtttaccgtacgttacgagtaacggttacgttaagtttaaacttaacgtttaacgtacccgtacggttaccggttaccggttaaccggggaacccgtaaacggggttaaccggtaagggtaaacgttaaccgtaaacggtaaaccgtacgttacggtacggtaccgttacgccgtaacgttaccgtaccgttttacgtaccgtttaccttacccgtttacccgttacccgtacttaccggtacttaaccg

SEQ ID NO: 170000 - DNA, 828 bp, Homo sapiens
  misc_feature: GYAE6OF02F3RNP.37.11.A11.1.454.CMB.1.raw
  modified_base (486)..(486): a, c, t, g, unknown or other
  misc_feature (486)..(486): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctccagacctccctggctgtgtctcgtagggacgagacgggccctacgtatactaacgtcgacgaacgtccgacgaccctaaggtacctttaggtttttaactaacgtaccgtacccttaacccgaaaaccgttaaaacgtaaaaccggttaaccttaacgtttacggtaccgttttacggtaactaccgaagaccgtaaaacggaaaaccggtacggggaccgtaccgtaaccccgttaacccttaaacgtcgtaccttacgttacgtttcggacggtaccttaacgtacccgggttacccgggacggttccccggggtacctacggtaccgtacgtctagggtcgngtacggtccggtacgttacggactagttacttccgacgttccactaaccactaaccgaaccgtcgtacgtacgacgtacggtctagggagtacgtggtacgtacgtttaagttaccgttacgtcgtacgtaacgactttaacgttaagtttaaacctcggttaccctaccccggtacgggttaccctaaacccgggacccgttaaagggaaacccgggttaaggtaaaccggtaacgtaaaccggtaaacgttacggttacgacggttaccgtacgtaccaacggttaccctcggtttaccttaccgtcttacccgttccgtaaccctctacgtacggtaac

SEQ ID NO: 170001 - DNA, 932 bp, Homo sapiens
  misc_feature: GYAE6OF02GKRFK.37.11.A11.1.454.CMB.1.raw
  modified_base (225)..(225): a, c, t, g, unknown or other
  misc_feature (225)..(225): n is a, c, g, or t
tcagtagtgtagatcacgaccggtgctcgatttagctacgactgcaggggcagcaagatggtgttgcagacccaggtcttcatttctctgttgctctggatctctggtcgccgtacggggacaccgtagatcgacccagtctcacgactccctggcttgtgtctcgtgggacggaggacggcctccatcaactgacaacgtccagccaagtacgtagtttttaanactacgaccttaccaaaactaaaacgtaaacgaaccttacgtttaaggtaccgtttacggaaactcgaagaccgaaacggtaaaaccggaacggggtaccaacggtacccttaacccgtaaactccggtacttaccgttaatttaccggtaggaccgtaacgttacccgggacccggggttaccgggttacccgggggtacccttacgggtaacccgtattacgaggtcggacgtaccggggtcgggtcgtaacggtaaccgtaaggtttactttccgaaaccggtccgtaaaccgtctaacgtaaccctagaaaccccgggtcgtaacggtccgtaagggaccgtagggtaacggtacgggttacggtacgggtaaacgggtttaaacttttaacccgggttaagttacccgggtttaaaccaaggggttaacccttaaagggttaagtttaaaccgttaaaactttacccggttaacccgggtacccgttaaccccgggttaccgaacccggggaaacgggttaaaccgtaaggggttaaaccggtttaaaaccgaacccggtaaaaacccgtacggtttacgggtacgtacccgggttactaaacccgtaacccgtaagttttaccggttaaccgttttccggttaaacccgttttcccgttaaccccggttaccctaacggtttaccgttaaattaaccccgg

SEQ ID NO: 170002 - DNA, 723 bp, Homo sapiens
  misc_feature: GYAE6OF02GEQEQ.37.11.A11.1.454.CMB.1.raw
  modified_base (287)..(287): a, c, t, g, unknown or other
  misc_feature (287)..(287): n is a, c, g, or t
  modified_base (501)..(501): a, c, t, g, unknown or other
  misc_feature (501)..(501): n is a, c, g, or t
tcagtagtgtagatcacgaccggtgctcgatttagctacgactgcaggggcagcaagatggtgttgcagacccaggtcttcatttctctgttgctctggatctctggtcgccgtacgggacaccgtgatcgacccagtcctccagaccgtcctggctagtcgtctcgtgggcgagacggcctcatacgaactgacaacgtccagaccagtacgtttagttttacacgacgtcctaccaaacaaagtaacgtaaccttacttacggtacgtttaggtaactccggaanaccgaaacggaaaaccggacgggacctaaccggtcccttaaaccgtaactcggttacctacgttaagttacggttacggacctacgtacccgggtaccgggtacggttcccgggtacgacgtacctagtacgtagtcggcggacggtcggttgaggtacagttctcgaactcactaacgactacgactacgtccgacacggtacgtgtaacggngtacggtgttacgggtatttaactttaggtccgtagaccgtaagtacttagttaattaaacctcgttacctcccgggtacgtacggtaggaaccgttaaggaaccgtttaggaacgaaacttaacgaaacggttagcgggttacacggtacaacccggttacacgtttaccctggtttaaccttccgtaccttcccggtcccgaatttaccctggtttaacc

SEQ ID NO: 170003 - DNA, 809 bp, Homo sapiens
  misc_feature: GYAE6OF02H2K23.37.11.A11.1.454.CMB.1.raw
  modified_base (152)..(152): a, c, t, g, unknown or other
  misc_feature (152)..(152): n is a, c, g, or t
  modified_base (169)..(169): a, c, t, g, unknown or other
  misc_feature (169)..(169): n is a, c, g, or t
tcagtagtgtagatcacgaccggtgctcgatttagctacgactgcagggcagcaagatggtgttgcagacccaggtcttcatttctctgttgctctggatctctggtgccgtacgggacaccgtgatgacccacgtctccgagacctcccgnggctgtgtctcgtgggngagaggcctaccactcaactcgacctaacgtccacgaccgagtacgtttagttttaataaccacgtcctaaccaaacgaaattaaacgtaaacttacttagtcgtttacggtatcgagacgaacgaaaccgacgggacacgtaccttacctaaacgttcgtacttacttagttttacgtcggtactaacgttacccgggtacccgggtaccgggtacccggggttacccgttacggtacccgtacgttacggacgggttacggacgtacgggtccgggttacggtacgggtaacgtacgttaccttaacgtccttaccgtaccgaacctacgtaacgaacctacgtcccgtagtaccgtaacggtccgtaggtacgggtagtttacgggtagttaacgtttacgttttaacgtcgttcgtaacgtacggtaacgttacttaacgtttaacgttaaccgttaccgtacccgttaaccgggttaccggttacccggaaccgtaaaccggggtaccgtaacgggttaaccgaaacgttaaccgtaaaccgttaggtaccggttcggacgtaccgaccgttaccgtaacgttccgttacgttacttacctccgtttccccgtaccctacgttccttaagtaccg

SEQ ID NO: 170004 - DNA, 835 bp, Homo sapiens
  misc_feature: GYAE6OF02GQBS7.37.11.A11.1.454.CMB.1.raw
  modified_base (172)..(172): a, c, t, g, unknown or other
  misc_feature (172)..(172): n is a, c, g, or t
  modified_base (566)..(566): a, c, t, g, unknown or other
  misc_feature (566)..(566): n is a, c, g, or t
tcagtagtgtagatcacgaccggtgctcgatttagctacgactgcgaggggcagcaagatggtgttgcagacccaggtcttcatttctctgttgctctggatctcgtggtcgtccgtacggggacacgtgatcgaccagtcctccagcctcccgtggtctggtgtcgtacgnggggaccgaggacggccttaccataccgaagtcgaccgtacgtccgaggaccagttacgtttagttttaacgaacgacgacctaaccaaacgtaaagttaaaccgtaaccttaacgttagtaccgtttaagggtactacgtaagaaccgaaacggaaccggacggccaaccgtccctaaacgtaacgtcgtaaccttacgttacgtttacggcggtacctaccggttacccgggtaacccgggtccggtaccccgggtccgtaggtacccgtacgttacgacgggttcgaacggtacggtcggtacggtacggaacgtacgttaccttacgaccgtccgtaacctacgaacctaaccgaaccgacggtcgtacgaaccgtacggtcgtaacggngttaggtcggacggtttagttaaactttacgtacgtcgacggtacgttaataagtttaccttaaacctaagtttcccgtaaccgggtttaccggttacggaacccggtaaaccgggtaacccgtaaaggtaacggttaaacgggaaaccttaaacggtaagtaaccgggttgttaccgaagttacccggtaacttaacttcccgggttgtttaaccctttccgtttcccgttaacccgttccgttcccctactttccggtaacttaacg

SEQ ID NO: 170005 - DNA, 835 bp, Homo sapiens
  misc_feature: GYAE6OF02FQMB9.37.11.A11.1.454.CMB.1.raw
  modified_base (550)..(550): a, c, t, g, unknown or other
  misc_feature (550)..(550): n is a, c, g, or t
tcagtagtgtagatcacgaccggtgctcgatttagctacgactgcagggggcagcaagatggtgttgcagacccaggtcttcatttctctgttgctctggatctctggtcgcgtacggggacaccggtgatcgacccagtcctaccagacctccctggctgtgtccgtcgtggggcgaggtacggcctcctatacgaactacggtcaacgtaccacggaccacgtacgttacgttttactaacgacgacctaaccctaaacaaaattaaacgtaactaacgttacgttacgttacggttaactcgacgaaccgaaacggaaaaccggtaacggggctaaccgtcccttaaaccctaaaacgtcgtaccgtttaaccttaaggttttacgtacgggaccttaccggttaaccccggttacccggggaccggggttcccggggtaccctaacgggtaacccttaacggttacggagggtcgggtaccggaccgggttacgggttaccgggacggtaacgacttttacggtcccttacgcgtcctaaaacggnttaaccaaccggcgtaccctagcggtacgtacggtaggaggtaacgtcggtagttacgttacgtttacttacgtcgtacgtacgtaacgtattacgttaacgttaacctaccgttccgtacccgttaccgggtaccgtaccgggtaaaccgggtaacgaacggttacggtaaacctacggtaaacggtaaccgttacgtggtaccgacggtaacctaacctacgggttccttaccgttaccgttacttcccggttacctaccccgtacttacggtacttaacccg

SEQ ID NO: 170006 - DNA, 748 bp, Homo sapiens
  misc_feature: GYAE6OF02F2VH9.37.11.A11.1.454.CMB.1.raw
tcagtagtgtagatcacgaccggtgctcgattagctacgactgcagggcacgcaagatggtgttgcagacccaggtcgttcatttctctgttgctctggatctctggtgcctacgggacaccgtgatgacccagtctccagactccctggctgtgtctctggcgagacggccctccatcaacctgcaagtccagccagacctgtttacaccagctaccacaactacgactacttagcttagtatcagcagaacccagggccagcctcctaacctgctcatttacgtggcatcgtaccgggtgtccgggttccctgaccgtattcgacgtggtccacggccgggttacgtgggtacctaggtactttaccaccgttcctacaaccctataccgtaaacccacggcccttggccagggtaccgtaggagggtacgtaggtacgggtacgttaactttaacgtttaccgttacgtactaacggtacgtaacggttaactttaaccttaaccttaaccgtacccggtacccggtaaccggttacccgggtccggtaaaaaaaaaccggggtcccgttaaacgggtaaccgggtaaaacgtaaccgtaaacccggtaacccttacgggttaccgggtaccggtaccggtacccgtaacccctaaccgtttacccgttaccggtttacctttacccggttaaccgtttaccccgtttacccccgtaccccgttaccgttacccgttaacccggg

SEQ ID NO: 170007 - DNA, 751 bp, Homo sapiens
  misc_feature: GYAE6OF02ICUG7.37.11.A11.1.454.CMB.1.raw
  modified_base (239)..(239): a, c, t, g, unknown or other
  misc_feature (239)..(239): n is a, c, g, or t
  modified_base (506)..(506): a, c, t, g, unknown or other
  misc_feature (506)..(506): n is a, c, g, or t
tcagtagtgtagatcacgaccggtgctcgatttagctacgactgcaggggcagcaagatggtgttgcagacccaggtcttcatttctctgttgctctggatctctggtgccgtacggggacaccgtgatcgacccagtctaccagacctcccgtggctggttctcgtcgtgggcgaaggacgggtccctaccaatactaactcggacaacgtaccgacgaccagtactttagttttaanaacgacgtacctaccaaaaactaaaacttaaacgtaaaccttacgttaacgttcgtttacggtactacgaaggaaccgaaacggaaaaccgtgggaccacgtaccctaaccgtaacgtcgcttacttaagttacgcggtaacctacgttaccgggaccgggtacggtcccggtccgtacggaccgtagttcgacggtgacggtacggtcgggtacgacggacgttataactccgactacctacaaccgtactacaacgtccgtaccncgtagcgtacggaggtaggtgttacggacgttacgttaatttacgtacgtcgtaactacggtaacttagttaaacttacgtaaccttacccgttacgttaccggtaccggtaccggtaaccgaacggggtaaaccgtacggtaagtaaaaccgacgtaaaacgtagtcgtacgtcgaaccgtcgtaacctacgttcgttaacgttccttacgtacccttaccgtcctacgtaaccgttataaccg

SEQ ID NO: 170008 - DNA, 560 bp, Homo sapiens
  misc_feature: GYAE6OF01BM79C.44.74.G08.1.454.CMB.1.raw
  modified_base (277)..(277): a, c, t, g, unknown or other
  misc_feature (277)..(277): n is a, c, g, or t
  modified_base (417)..(417): a, c, t, g, unknown or other
  misc_feature (417)..(417): n is a, c, g, or t
tcagacagtatatacacgaccggtgctcgatttagtagctctatcaggggagctgtgggctcagaagcagagttctggggtgtctccaccatggcctggacccctctctggctcactctcctcactctttgcatagggtctgtagtttcttctgggctgactcaggagtctgctgtgtctgtggccttgggacagacagtcaagatcacatgccacggagacagcctcagagggcactatgcaagctggtaccaacagaagccgggacaggcccctntacttgtcatgtttaggaaaaaccgccggccctccgggatcccagaccgattctctggctccacctcaggaaacacagcttcctgaccatcactggactcaggcgaagatgagctagactattatgcagcagtccggganagtagtaatgtacttagttgtttcgaccgtacccgggtacctaaggtccaccgttccgttagggtcctaacggccccaaacgggcccctaaacccccgtacgtcgtaccctaacccttcccgttccgttccccccgtaccccc

SEQ ID NO: 170009 - DNA, 548 bp, Homo sapiens
  misc_feature: GYAE6OF01EGXEO.44.74.G08.1.454.CMB.1.raw
  modified_base (329)..(329): a, c, t, g, unknown or other
  misc_feature (329)..(329): n is a, c, g, or t
  modified_base (419)..(419): a, c, t, g, unknown or other
  misc_feature (419)..(419): n is a, c, g, or t
tcagacagtatatacacgaccggtgctcgatttagtagctctatcaggggagctgtgggctcagaagcagagttctggggtgtctccaccatggcctggacccctctctggctcactctcctcactctttgcatagggtctgtagtttcttctgggctgactcaggagtctgctgtgtctgtggccttgggacagacagtcaagatcacatgccacggagacagcctcagagggcactatgcaagctggtaccaacagaagccggggacacggcccctctacttgtcatgtttggtaaaaacgccggccctcgggatcccagcgattcnctgctccacctcagaaacacagcttcctgaccatcacgtggactcgaggcggaagagtgaggctgaactattatgctagcagtccggganagtagtaatgtcttagtgttttcgacgacccgggactaaggtcctaccggtcccttaggtccaggaccccaacgggccccaaacccccgtcctacggttcccaaccttccgttccgttcccccgtcccc

SEQ ID NO: 170010 - DNA, 590 bp, Homo sapiens
  misc_feature: GYAE6OF01AFVSD.44.74.G08.1.454.CMB.1.raw
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccgccgaggctccgaggggagggctgggagtgggtgcgtatagaacaagctgacggtggacagcagactacgctgcaccgtgaaaggcagntacacatcanaagnatgatanaaagtntacgtntctgtgacagactagaacngcctagaaccaccggagaccacgacgccgttatacgttacgtgtacggtagggtactttcgggtttaccaggtttccggggccgtaaccggggtaccccttgggtacccctacccggttccttacccgtacgacccgtcccctaaccgacccggtaacccggg

SEQ ID NO: 170011 - DNA, 547 bp, Homo sapiens
  misc_feature: GYAE6OF01BT5SZ.44.74.G08.1.454.CMB.1.raw
  modified_base (285)..(285): a, c, t, g, unknown or other
  misc_feature (285)..(285): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggatttccttgctgctattttaaaaggtgtccagtgtgaggtgcagttggtggagtctggggggaggtttggtaaagcctggggagtcccttagactctcctgtgcagcctctggattcactttcagtaacgcctggatgacctgggtccncaggctcgagggagggctggagtggtgcgtatagaaccaagctgacggtggacagcagactacgctgcaccgtgaacgcagatcacatcncaagngatgattacaaagtntacggtntctctgacagtatagaacngacctagaacaccgaggacacagcctactattctgtcgtgggtacttggttcaggttccgggcctaagggacccttggaccctaccggttcctcccgtacacgcccctccgaacccggtaaccggg

SEQ ID NO: 170012 - DNA, 637 bp, Homo sapiens
  misc_feature: GYAE6OF01BWKF7.44.74.G08.1.454.CMB.1.raw
  modified_base (479)..(479): a, c, t, g, unknown or other
  misc_feature (479)..(479): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggagtttggtaaagccgtggggagtcccttagactctcctgtgcagcctctggattcactttcagtaacgcctggatgacctgggtccgccaggcctacgagggaagggctgggagtgggtgactaattatatcaggaagataggaattggaaagaacacgtacggagactaccgaggaacggctatcgaccgtcaccgagagacactccgaaggaacacactgacatctagacaaatcgaacaacctcaaccgaagtcgagacacgggtctgtactagtttnttaggtcgacgacgaccgtcccccgttacggaccggtaccccgggtcccccgtacgttacggtaacccgtacgggtccgggggaaccccaaccgggggtaaacccccgttcggggtaaccccgtacccccggttcccttccccgtccgtaacccccgg

SEQ ID NO: 170013 - DNA, 744 bp, Homo sapiens
  misc_feature: GYAE6OF01C4KM8.44.74.G08.1.454.CMB.1.raw
  modified_base (444)..(444): a, c, t, g, unknown or other
  misc_feature (444)..(444): n is a, c, g, or t
tcagacagtatatacacgaccggtgctcgatttagtagctctatcaggggagctgtgggctcagaagcagagttcgtggggtgtctccaccatggcctcggacccctctctggctcactctcctcacttctttgcagtagggtctgttagtttcttcgtgggctgactcgaggagtctgctgtgtctggtcggtccgttagggacagacagtacaagactcacatcgaccgaacggagacacgcctacgaaggacggctacgtagacgacgaagcgtaacggaaccaacgaaggaacggccggaacgaccggtccccgttacgtacgttcgtactacgttacggttaaacggtaaaaccggcccggtacccgtaccgggactacccgacggtaccgtacgttccgtccgtcggtaccctacccgtacgtacgaaacggaaaccncgtacgttacctttaccgtaccgaacctacgtaccgtacgggtacggtaccgtacggaacggggacgtaagacggtacgggtaacgtacgttaacggttaattacgtttaacgcggaaccgtacggtaccggtaacggttaccgggaacttaagggttaactaacgttcggtaacgttttcgttaacgggttccgaacccggtaccgggtaacgtaacggtcccgttaccgtacgttacggccgaccgacccgtacggacccctaacgtctccgtactaccgttcctcccgtccctaccg

SEQ ID NO: 170014 - DNA, 789 bp, Homo sapiens
  misc_feature: GYAE6OF01C6O3B.44.74.G08.1.454.CMB.1.raw
  modified_base (170)..(170): a, c, t, g, unknown or other
  misc_feature (170)..(170): n is a, c, g, or t
  modified_base (185)..(185): a, c, t, g, unknown or other
  misc_feature (185)..(185): n is a, c, g, or t
  modified_base (760)..(760): a, c, t, g, unknown or other
  misc_feature (760)..(760): n is a, c, g, or t
tcagacagtatatacacgaccggtgctcgatttagtagctctatcagggggcccccagccttgggattcccaggttgttttcattcagtgatcaggactgaacacagaggactcaccatggagtttgggctgagctggtacttttccgtgctgacttaagttttaaaggngtccagtgtgagtgnagttggtggagtcggtggggtagtttggaaagccgtaggggactcccgttagactctccgtgtacgcgacgtcctcgtggtacttccgtaacttttcgaacgttaaaccgccgttaggtaactccggaaccgttcggggtcccaccggaacggtccgtaccggaagggggtaacgggtcgtaggggtaagggtttcgggttacggaccgttaaagtaaaccggaaaccgtaaacggtcgtacgggacgggtacggaaaccacggaaccgaacggtaacccgtcgtcgtacggacccgtaaaccggtaggaaaacggcaaacgtcttaacccgaactaacgttaccgtaagaaacggtaagtagtaacggtaaactaaaccgtaaaaaggtacgttaacgggtcgttacgtacacgagtaagacgtaaacgaacgtacgtaccgtaacgaacgtaaccgaacggaaccaacgacgtaccgtacttacgtacgttacggtgtaggtacgttcgtaccgtacgtaccgggaacgtaaccggtacccgtcggtaaaccctcccgtaaccttccaacccncggtacccctaccggaaccggtaacccgg

SEQ ID NO: 170015 - DNA, 780 bp, Homo sapiens
  misc_feature: GYAE6OF01A7CCR.44.74.G08.1.454.CMB.1.raw
  modified_base (233)..(233): a, c, t, g, unknown or other
  misc_feature (233)..(233): n is a, c, g, or t
tcagacagtatatacacgaccggtgctcgatttagtagctctatcagggggcccttccaatatcagcaccatggcctggactcctctctttctgttcctcctcacttgctgcccagggtccaattctcagcctgtggtgactcaggagccctcactgactgtcgtccccaggagacacagtcactctcacctgtcgcctccagcactggagcggtcaacgagtgtatttttangacaaactggttccagcagaaacctggaccaaccaccgacgggccctgtatttagtaggtacacgcatcagactacttcctcggaccctcgtcccggttctcgacggtcctcccgtccggtcggggggactacgtacgtcgtcgttcctcggacttccgttcgttccgtcggtaccggtaccggtccgtacgggaacgggtacggacgggtccgttacgttaacgttttttaccgtcgttccccgttccttaccttaacccgtaacggtcgggttacgtaccgttcccgacgaaccggtaacccgttaaaggtttcgggggtttacggttaccgggggaccggggtaacggggtaacccggttaacgggtttacccggaacccggtttaccggttaacgggtcccgaacgggtaccccggaaacgggtcccgttccccgggttcccccccggttacgggttaccccttacccgttccccgtttaccccgggtttccccccgtaccccgtttccccgtttacctttaaccgtttcccgtttacccggg

SEQ ID NO: 170016 - DNA, 560 bp, Homo sapiens
  misc_feature: GYAE6OF01EIOE5.44.74.G08.1.454.CMB.1.raw
  modified_base (347)..(347): a, c, t, g, unknown or other
  misc_feature (347)..(347): n is a, c, g, or t
  modified_base (393)..(393): a, c, t, g, unknown or other
  misc_feature (393)..(393): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttccttgctgcttattttaaaaggtgtccagtgtgaggtgcagttggtggagtcgtggggggagtttggtaaagccgtggggagtcccttagactctcctgtgcagcctctggattcactttcagtaacgcctggatcgacctgggtccgcaggctaccgagggagggctggagtgggtgcgtagtagaccaagctgacggtgggacngcagactacgctgcgaccgtgaaaggcaagatcaccatcacagaanatgatacaaagatacggtgtctactgacagtatagaacaggcctagaacaccgaggacacgacgccgtacttactacgtgtcgtggattggttcacgttccgggactaacggggaacccgtggtaccccgtccgtcgtcccacgacgcccctacgaccgtaacccgg

SEQ ID NO: 170017 - DNA, 809 bp, Homo sapiens
  misc_feature: GYAE6OF01CABBM.44.74.G08.1.454.CMB.1.raw
tcagacagtatatacacgaccggtgctcgatttagtagctctatcagggggcccccagccttgggattcccaggtgttttcattcagtgatcaggactgaacacagaggactcaccatggagtttgggctgagctggtattttccttgctgtcttaagtttttaaaaggtcgtccagtgtgaggtgcgtaggttgggtggtagttcggtggggggtaggttttaggtaaaaggccggtggggacgttccccgttagacttcctccgtgtgcagtcctcgtggtattcctactttcaacggtaaccgtccgtaggtacttcggacccgttcggggtacccgaccggtacggtccgtaccggaagggggaacggggtcggtaggggtagggttcgggggtttacgggaccggtttaagtaaacggaaacccgaaaaggtccggtacgggtaaccgggtaggggaaccgtagaccgtaaggtaccgtaacggtacgtcggaacccggtaacccggaaagggaaacggtaccgtaagtaacgtttacccaaccgttacgtacgtaacgaaggtaaggtattaaccgtaaagttaaaccgaaagttacggttaccgggtcttaccggtctaggaccgaagtacgtaagaaactccgtaccgtacgaaccgacgacgaacgaaccgtacggtaccgttacttacgttagtcgtacggtacggtgtttcgtacgtcggtaccggaccggtacggttacccggtgttaccctacccgtctccccgacgtacccgcccgtaacccgcccggtaaccgg

SEQ ID NO: 170018 - DNA, 566 bp, Homo sapiens
  misc_feature: GYAE6OF01B6HHM.44.74.G08.1.454.CMB.1.raw
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
  modified_base (472)..(472): a, c, t, g, unknown or other
  misc_feature (472)..(472): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttcctgctgctattttaaaaggtgtccagtgtgaggtgcagttggtggagtctggggggaggtttggtaaagcctggggagtcccgttagactctcctgtgcagcctctggattcactttcagtacgctggatgacctgggtccgccaggctccgaggggaaggggctggaggtgggttggccgtattagaaccaagctaggacggtgggacagcagactacgctgcacccgtgaagcagntcacntcnaganatgattacgaaangtacggtatctctgacagagtgaacngccctagaacaccgagaaccacgacgccgttactaattacnggtactgggattcggttactacggtcgggccgtagggaaccccgttgggtccctaccggttcctcctaccagtccccttcgaaccgtacccggg

SEQ ID NO: 170019 - DNA, 882 bp, Homo sapiens
  misc_feature: GYAE6OF01CADPU.44.74.G08.1.454.CMB.1.raw
tcagacagtatatacacgaccggtgctcgatttagtagctctatcgagggggcccccagccttgggattcccaggtgttttcattcagtgatcaggactgaacacagaggactcacagtggtaggtttgggctgaggtcgtaggtactttttccgttgtcgttgtactttaaagtttttaaaggtcgtacgtaggtggttaggagggtgacgtaggttgggtaggtaggttgggtaggggggttaggtttaggtaaacggcgggttaggggtaccgttaccgttagtaccttccgttccgttggttcgtaccgtccgttcgtaggtacttccgtacttacgaagtaccgcgtaggtactccggtacgttcgggtacccgaccggtacggccgtacgggaagggggtacggggtcgtagggtacgggttcgggggtacgtacccggttaaggtaaccgaaaccggtaaggtccgggttagggaaccggggtaggaacgacggtaccgaacggttaccgtacggtccgaccggtaacccgtaaccgggaaagggtaacggtaactaacggttaacctacccgaaccgtagttacgaacggtaaagtacgtattaacgtaaacgttaaaggtaaaaccgttcggttaaccgtttacgtcccgttaacggacgtaacaaggtacgtaaccgaacgtaccggtacgtaaccggaacccgtaacgggaaacgaccgtaaccgtaaccggttaccgttaaccgtttagttacccggttacgtaggtacggttacgtttcgtacggtaccggtacgggtaccggacggtccgttacggtcccgttaccgcgtacctactacccggacctacccggcgttaacccggcccg

SEQ ID NO: 170020 - DNA, 747 bp, Homo sapiens
  misc_feature: GYAE6OF01CHH4U.44.74.G08.1.454.CMB.1.raw
  modified_base (236)..(236): a, c, t, g, unknown or other
  misc_feature (236)..(236): n is a, c, g, or t
  modified_base (270)..(270): a, c, t, g, unknown or other
  misc_feature (270)..(270): n is a, c, g, or t
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
  modified_base (678)..(678): a, c, t, g, unknown or other
  misc_feature (678)..(678): n is a, c, g, or t
tcagacagtatatacacgaccggtgctcgatttagtagctctatcagggggcccttccaatatcagcaccatggcctggactcctctctttctgttcctctcactgctgccagggtccaattctcagcctggtggtgactcgaggacgccccttcaactgtacgtcggtccgtccccgaggacgactacacgttcacctcctacgtaccgttgtccgccctccaacggcctacggnggacggtcgtaacaactaggttattaatttttancgaactaacgtcggtacagacaacgaaacgtcgaacaccgaccggcgcctatacttanagtacgacgcacgtacatacgtccttaccgtccggtaccctccggtcccgttacnccgacgtcccgtacccgtcgggcggggactacgcggtcctcgtaccgtcgtactccgttggtaccttcggaccggtcgccgtaggacggacgtacggtcgtacgttactttcgcgttacccgtctaccgttactacggtcggacgttccgaccgtccgtaacggtaacgttaacgggttgggtccggggtaggaccggtaaccgggtaacgtaaccggttaccgtccggttaacccgtcggtaccggacccgggtaccgtacccgggtcccgtaccccgtacccgggttaccccnccggtacccttccccgttaccccgtaccctttaacccctttccgttaacttaacgttacccgttaacgg

SEQ ID NO: 170021 - DNA, 529 bp, Homo sapiens
  misc_feature: GYAE6OF02FWFIV.44.74.G08.1.454.CMB.1.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
tcagacagtatatacacgaccggtgctcgatttagtagctctatcagggggcccttccaatatcagcaccatggcctggactcctctctttctgttcctcctcacttgctgcccagggtccaatttctcagcctgtggtgactcaggagccctcactgactgtgtccccaggagacacagtcactctcacctgtgcctccagcactggagcggtcaacagtgatttttangcaaactggttccagcagaaacctggacaaccacccagggcccctgatttatggtacacgcatcagacattccnggacccctgcccggttctcaggctccctccgtggggcatacgctgtcctgactcctgtctgacgtacggcctgaggacgaggctgtacttttactgtcctcctctaccatggtgactccgcacgccaaagttgggtgttcgggcggagggaccgagttgaccgtctaggtcagcccgaaggctcgcccctcggtccactctcgtcccaccctcctctactatacc

SEQ ID NO: 170022 - DNA, 525 bp, Homo sapiens
  misc_feature: GYAE6OF02FU4RG.44.74.G08.1.454.CMB.1.raw
tcagacagtatatacacgaccggtgctcgatttagtagctctatcagggggcccttccaatatcagcaccatggcctggactcctctctttctgttcctcctcacttgctgcccagggtccaattctcagcctgtggtgactcaggagccctcactgactgtgtccccaggagacacagtcactctcacctgtgcctccagcactggagcggtcaacagtgatttttatgcaaaactggttccagcagaaacctggacaacaccagggccctgatttatggtacacgcatcagacattcctggacccctgcccggttctcaggctcctccgtgggggcatagctgtcctgatcctgtctgacgtacggcctgaggacgaggctgacttttactgcctcctctaccatggttgatccgcacgccaaagttcgggtgttcggcggtagggacctaagttcgaccgtctaggtcagcccaaggctcgcccctcggtcactctcgttcccaccctcctcttatactacg

SEQ ID NO: 170023 - DNA, 576 bp, Homo sapiens
  misc_feature: GYAE6OF02HKNNS.44.74.G08.1.454.CMB.1.raw
  modified_base (336)..(336): a, c, t, g, unknown or other
  misc_feature (336)..(336): n is a, c, g, or t
  modified_base (384)..(384): a, c, t, g, unknown or other
  misc_feature (384)..(384): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttccttgctgctattttaaaaggtgtccagtgtgaggtggccctgttggagtctgggggaggattggcacagcctggggggtccctgagactctcctgtgcagcctctggccttcccctttaggagctatgccatgacctgggtccgccaggctccgaggggagggctcgagtcgggtctcgacagttggcgctagngcaactgacacatacgtacggagagtccgtgaacgggccgcttcaccntctccagacgacaactaccgaaacactacttttctagtaatagaacacgctagagagtacgaagacaccgtcctttattcgttgtgacggaagggaggggggtacgtacggacgtccgacgtaggttgggtacgggtcggttacgtacgtccggtcgggccgagggcggccgtggtccgaccggtccgccgg

SEQ ID NO: 170024 - DNA, 725 bp, Homo sapiens
  misc_feature: GYAE6OF02H7CIN.44.74.G08.1.454.CMB.1.raw
  modified_base (230)..(230): a, c, t, g, unknown or other
  misc_feature (230)..(230): n is a, c, g, or t
tcagacagtatatacacgaccggtgctcgatttagtagctctatcaggggagctgtgggctcagaagcagagttctggggtgtctccaccatggcctggacccctctctggctcactctcctcactctttgcatagggtctgtagtttctctgggctgactcaggagtctgctgtgtctggtggccttgggacagacagtcaagatcacatgccaaggagacagccctanaagaagctaattatgacaagctggtaccagcaagaacgccaggacacggcccctgtacttgtcatctatacgaaactaaaaaccgaacccgcctacgacggactcccgaagaccgtattcctcgtcggcctacagcctacgaacggaaacacgacgtccttccgttagaaccctacgtaccgtaccgtacgggggtacctaccgggaagggacccgggaagtacggtaggaacggtcgtacgtaacttaagttaaccgtacggtaaaccggtaccccgggtaaacctaaaccggtacggttaacggttaaacccttacgggtttacgggggttacgggtttaacccggggacggggtaaccggggaacccgtaaacgggtccggtaacccgggtaaccccggttccggtaaaccgggttaccccgaaccgggtaaccccgttaaccgggcccgttacccccggtaccccccggtaccggtaccccttaaccccgg

SEQ ID NO: 170025 - DNA, 528 bp, Homo sapiens
  misc_feature: GYAE6OF02FV2O0.44.74.G08.1.454.CMB.1.raw
  modified_base (229)..(229): a, c, t, g, unknown or other
  misc_feature (229)..(229): n is a, c, g, or t
  modified_base (524)..(524): a, c, t, g, unknown or other
  misc_feature (524)..(524): n is a, c, g, or t
tcagacagtatatacacgaccggtgctcgatttagtagctctatcagggggcccttccaatatcagcaccatggcctggactcctctctttctgttcctcctcacttgctgcccagggtccaattctcagcctgtggtgactcaggagccctcactgactgtgtccccaggagacacagtcactctcacctgtgcctccagcactggagcggtcaacagtgatttttangcaaactggttccagcagaaacctggacaaccacccagggcccctgatttatcggtacacgcatcagacattcctggacccctgcccggttctcaggctccctccggtgggggcatagctgtcctgatcctgtctgaccgtacggcctgacggacgaggctgacttttactcgcctcctctaccatcggtgactccgcacgcctaaagttgggtcgttcggcggagggacctaagttcgaccgtctaggtcacgccaggctcgcccctcggcactctcgtcccaccctctctatntacg

SEQ ID NO: 170026 - DNA, 695 bp, Homo sapiens
  misc_feature: GYAE6OF02HW90E.44.74.G08.1.454.CMB.1.raw
  modified_base (287)..(287): a, c, t, g, unknown or other
  misc_feature (287)..(287): n is a, c, g, or t
tcagacagtatatacacgaccggtgctcgatttagtagctctatcagggggcccccagccttgggattcccaggtgttttcattcagtgatcaggactgaacacagaggactcaccatggagtttgggctgagctggattttccttgctgctattttaaaggtgtccagtgtgaggtgcagttggtggagtcgtgggggaggtttggtaaagccgtggggagtcccttagactctcctgtgtagcctctggattcactttcagtaacgcctggatgacctgggtccnccaggctccgagggagggctggagtgggttggccgtagttagaaccaaagctgacggtggacagcagactacgctagcgaccgtgaaaggcagattcaccatctacaagagacgtagaattacgaaaaagtacgttaacggttacggttctacgtcgacgaagtaagtaagaaccgaagacccgttaacgaaaccgaccgaaaggacgaacccgaacggcccgttaccttaacgtttaacgttcggttccgttaggggtacgtttacgggtttacgtaccggtttaccgggggtacccgtaaccgggggtaacccccgttaggggttaccccgtaacccggttccccgttaccgttacccgacccggttacccccgtacccgtaaccccggaaccggggtaccccccg

SEQ ID NO: 170027 - DNA, 539 bp, Homo sapiens
  misc_feature: GYAE6OF02F8PIP.44.74.G08.1.454.CMB.1.raw
  modified_base (284)..(284): a, c, t, g, unknown or other
  misc_feature (284)..(284): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (481)..(481): a, c, t, g, unknown or other
  misc_feature (481)..(481): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttccttgctgctattttaaaggtgtccagtgtgaggtgcagttggtggagtctgggggaggtttggtaaagcctggggagtcccttagactctcctgtgcagcctctggattcactttcagtaacgcctggatgacctgggtccnccaggctccgagggagggctggagtgggttggccgtattagaaccaagctgacggtgggacagcagactacgctgcaccgtgaaaggcagattcaccatcctacaagagatgattacaaaagntacggtntctactgcagatagaacagcctagaacaccgaggacacagccgtatattactgtatgggattggttnacgtcggccaggaccctggtcctaccgtctccgtcgacgtccctaccgaccgtacggg

SEQ ID NO: 170028 - DNA, 670 bp, Homo sapiens
  misc_feature: GYAE6OF02G91JK.44.74.G08.1.454.CMB.1.raw
tcagacagtatatacacgaccggtgctcgatttagtagctctatcagggggcccttccaatatcagcaccatggcctggactcctctctttctgttcctcctcacttgctgcccagggtccaattctcagcctgtggtgactcaggagccttcactgactgtgtccccaggagacacagtcactctcacctgtgcctccagcactggagcggtcaacagtgtatttttatgactaaactggttccagcaagaaacctggaccaaccaccagggcccctagactttatggtacacgcaatcaagacattccctcggaccccctggccccggttctcgacggccttccccgtcggtgggggcatacggctcgtcctgactcctgtctggaccgtaccggtccgtaggacggaccgacgggtccgttacgttacgtttttaaccgtcgtcccttcccttacctaccgtagttcggtagtaccttccggctaacgacctaaaggttcgggttcgggttcgggaccgggtagggtacccgtaaggttaccgtaacccggttccgtaacgggtccaccggacccgtaacggcccgtccggccccccgttacggtccctaccgttccgttcccggttaccccgtcccgtaaccgtccccttacgttaacgttacccg

SEQ ID NO: 170029 - DNA, 534 bp, Homo sapiens
  misc_feature: GYAE6OF02I15BY.44.74.G08.1.454.CMB.1.raw
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
  modified_base (482)..(482): a, c, t, g, unknown or other
  misc_feature (482)..(482): n is a, c, g, or t
tcagacagtatatacacgaccggtgctcgatttagtagctctatcaggggagctgtgggctcagaagcagagttctggggtgtctccaccatggcctggacccctctctggctcactctcctcactctttgcatagggtctgtagtttcttctgggctgactcagagtctgctgtgtctgtggccttgggacagacagtcaagatcacatgccacggagacagcctcagagggcactatgcaagctggtaccaaacagaaagccgggaacaggcccctcgtacttgtcatgtttagtaaaaacgaccgccctccgggatcccagaccgatctcnggcctccacctcagaaacncagcttcctnaccatcactggactcaggcgaagntnagctgacctattattgctagcatccggtanagttagtaactgacttatcgttttcgactacccgggaccaaggttccacgttccttacgggtnaccggcccaaaggcccaaaccccacgtggtccaacgtccttcgtcccctccc

SEQ ID NO: 170030 - DNA, 956 bp, Homo sapiens
  misc_feature: GYAE6OF02HY9IY.44.74.G08.1.454.CMB.1.raw
tcagacagtatatacacgaccggtgctcgatttagtagctctatcagggggccccagccttgggattcccaggtgttttcattcagtgatcaggactgaacacagaggactcaccatggagtttgggctgagctggattttcctgctgctattttaaaaggtgtccagtgtgaggtgcagttggtggagtcgtggggggaggttttaggtaaaggtccgtggggtagttcccgttaaggaccttctcccttgtcggcacggtccttcgttaggtactttcctacttttaccgaacgttaaccggtcccgttagggtaacttccggaacccgttcgggggttaccccgccccgtaacgggtcccgttacccgggaacggggggtaaacggggggtccttaggggtaacggggtttcggggggtttcgggtaaccccgggtttaaactttaaccggggaaaaccccgtaaaaagggtcccgttaacggggtaaaccggggttaccggggaacgtaacggtccgaaacgggtaaccgttaaccggtcccgttacggacccgtaacccgggttaaggaaaacggtcaaggtaccttaccaaccctatcgtaacgaaacggtagaacttaacgaactttaaacgaaaaacggtacgttaacgggttacgtcgttaccgtggacctaaggtaacgttaacgaaacctacggaaccgtacggaaaccgaaccgggtaaacgaacctaaccgaccggttacccggttaactttaacgttttaccgtcgggttaccggttaaggggtttacttaccggtttaccgttaccggggtttaaccccggtacccggggtaaccggggtttaacccctaccgggtttaccccgtaaccccggttccctttaccccggtacccggtacccgggtacccccctttaacccccggacccggtaaaccccgggg

SEQ ID NO: 170031 - DNA, 629 bp, Homo sapiens
  misc_feature: GYAE6OF02G9MCI.44.74.G08.1.454.CMB.1.raw
  modified_base (450)..(450): a, c, t, g, unknown or other
  misc_feature (450)..(450): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttccttgctgctattttaaaggtgtccagtgtgaggtgcagttggtggagtcgtgggggaggtttggtaaacgccgtggggacgtcccttagactctcctgtgcagcctcgtggattctactttcagtaaccgcctggatcggaccctgggtcccgccgaggcctaccggaaggggacggggctgggaggtcgggttcggccgttaatacggaaccaaaggtctaggacggtggacagcagactacgctcgccaccgtagaaggcagattcactatctacaagagatagtactaagaaagtacgtacggtntctacgtcgacgtagtatacgaactcgacgtacgaaccaccggagacaccgacgtaccttacgtacttcgtcgtacgtgggtatttcggttactaggttcccgggaccgtaccgggtacccgttcggtaccgtacccggttacctccgtaccgaccgtacccgtcccgacgtacccggg

SEQ ID NO: 170032 - DNA, 563 bp, Homo sapiens
  misc_feature: GYAE6OF02I5MVM.44.74.G08.1.454.CMB.1.raw
  modified_base (288)..(288): a, c, t, g, unknown or other
  misc_feature (288)..(288): n is a, c, g, or t
  modified_base (330)..(331): a, c, t, g, unknown or other
  misc_feature (330)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (337)..(338): a, c, t, g, unknown or other
  misc_feature (337)..(338): n is a, c, g, or t
  modified_base (340)..(341): a, c, t, g, unknown or other
  misc_feature (340)..(341): n is a, c, g, or t
  modified_base (344)..(345): a, c, t, g, unknown or other
  misc_feature (344)..(345): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (367)..(368): a, c, t, g, unknown or other
  misc_feature (367)..(368): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
tcagacagtatatacacgaccggtgctcgatttagtagctctatcagggggccccagccttgggattcccaggtgttttcattcagtgatcaggactgaacacagaggactcaccatggagtttgggctgagctggattttccttgctgctattttaaaaggtgtccagtgtgaggtgcagttggtggagtcgtggggggaggtttggtaaagccgtggggagtcccttagactctcctgtgcagcctctggattcactttcagtaacgcctggatgacctgggtccnccaggctccgagggagggctggagtgggtgcgtatagacagnngngngnngnngcnnctncaccgngaagnagntcacnncnagnatgatacaaagntacggtntctctgacagatagacngcctagaaccaccggaggacacgacgccgtactattactgtccttaggggacttgggtttacaggttccgggacccgtaacggggtaccccgttgggtacctacccggttcctacccgttaccgaccgtccccgtacccgaaccggtaacccgg

SEQ ID NO: 170033 - DNA, 581 bp, Homo sapiens
  misc_feature: GYAE6OF02IKS7S.44.74.G08.1.454.CMB.1.raw
  modified_base (187)..(187): a, c, t, g, unknown or other
  misc_feature (187)..(187): n is a, c, g, or t
  modified_base (295)..(295): a, c, t, g, unknown or other
  misc_feature (295)..(295): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
tcagacagtatatacacgaccggtgctcgatttagtagctctatcagggggcccccagccttgggattcccaggtgtttcattcagtgatcaggactgaacacagaggactcaccatggagtttgggctgagctggattttccttgctgctaattttaaaaggtgtccagtgtgaggtgcagttggnggagtcgtgggggaggtttaggtaaagccgtggggagtcccttagactctcctgtgcagcctctggattcactttcagtaacgcctggatgacctggtccgccaggcnccgaaggggtaagggctggaggtgggttcggaccgtagtaacgaaccaaagctaggacggtagggacaggacagactacgcgtgcaccgtgaaagcagactcacatctanaagngatgataacaaaagtctaacggtgtactgtnacgatagtacgaacacgtctaacgaacaccggagaaccagacgtccgtatattcctaggtcgtagggtatcggtttacaggttccggaactacgggaccttggtcccacgtctacccgtgacctccctacgacctaccggg

SEQ ID NO: 170034 - DNA, 767 bp, Homo sapiens
  misc_feature: GYAE6OF02HBWQI.44.74.G08.1.454.CMB.1.raw
tcagacagtatatacacgaccggtgctcgatttagtagctctatcagggggcccttccaatatcagcaccatggcctggactcctctctttctgttcctcctcacttgctgcccagggtccaattctcagcctgtggtgactcaggagccctcactgactgtcgtcccaggagacacagtcactctaccactcgtcgcctccacgcacgtggacgcggtacaacgagtcgttagttttagtgtactaaacgtcggttaccgagtaccgaacgaaaccctaggaaacctaaccccgaccccgtaccggggtaccccttagttaacttttaaggtccgggttaaaccaccggaccgtaacgtaccgaacggtaccttaacgtttacccgtaccgggtaacccccgtcggttaccccggttcgtaccgtacggtcccgttaccccggtccgggtcggggtactacgtaacggtccgttacgtcctacggtacttccgtcgtacgtacgtaccggtaccggcctacgggtagggaccgtaggtctagttaccgtttacgccgtcctccctactaccgtcggtgttactccgtacgcgtaacgtactaacgggttggttaaccgggtcgggacgggtaaccggtacgttaacgggttaccgtacccgggttacgtaaccggtcgaacccgtaccgtaacggtccgtcccggtacccgtacggtcctaccttcgtacccgttacccctacggtacctacgttactacctacgg

SEQ ID NO: 170035 - DNA, 500 bp, Homo sapiens
  misc_feature: GYAE6OF01BU8TU.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaatggtatcagcagaagccagggaaagcccctaaacttctgatctatgatgcaaccaatttacaagatggatccatcaaggttcagtggcgtgatcgtggggcgtatttcactctcacatcagcagtctgacaacctgaagtatttgcgtacttactggtgtcaactagggttatactactaacccgtactacttttcggacctagggaccaagcgtagacatcatacgactgtggctgcacatctgtc

SEQ ID NO: 170036 - DNA, 564 bp, Homo sapiens
  misc_feature: GYAE6OF01CBH5T.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaaaacttctgatctatgatgcaaccaatttacaagatggatcccatcaagttcagtggcggtggatcgtggggcggatttcactctcaccatcagcagtctgacaacctgaagtattttcgacgtactttacgtggtgttacgaaaccgtagggtttaataccgtaacttaaaccccggtacttaaccgtttttgggacccgtagggggaaccctaaggtcctagggaccagtcaagttaccgaaactggtggcttggaccaacctatcgttgttaccc

SEQ ID NO: 170037 - DNA, 508 bp, Homo sapiens
  misc_feature: GYAE6OF01B6QS7.14.30.C08.1.454.CMB.1.raw
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccaatttacaagatgggatcccatcaaggttcagtggcggtgatcgtggggcgatttcatctcaccatcagcagtctgcaacctgaagtattttgcgtacttacgtggtgtacaacgtagggttatacgactaacccgttactacttttggaccgtagggaccaagctggacagtcatacgactgnggctgcacntctgtcc

SEQ ID NO: 170038 - DNA, 525 bp, Homo sapiens
  misc_feature: GYAE6OF01A8SYM.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgactacccttttaaattggtatcagcagaagccagggaaacgcccctaaacttctgatctatgatgcaacaattacaagatggatcccatcaaggttcaggtgcggtgatcgtggggcgtatttcactctcaccatcagcagtctgacaacctagaagtattttgacgtactttacgtggtgtacaacgtagggttatacgtacttaacccgttactacgttttcggacccgtagggaccaagctaggacagtacatacgaactgtaggctcgcaccatctgttcc

SEQ ID NO: 170039 - DNA, 600 bp, Homo sapiens
  misc_feature: GYAE6OF01B8YS0.14.30.C08.1.454.CMB.1.raw
  modified_base (280)..(280): a, c, t, g, unknown or other
  misc_feature (280)..(280): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatccctccctgtctgcatctggtgggagacagaatcagcatcacttggccgggcaagtcaggccattgactaccttttaatggtatcagcagaagccgaggaacncccctaaactctagatctatgatgacaactaattacaagtatggactccatacaagttcagtggcggtgagtcgtggggcgtatttcactctcacctatcagctagtctgaccaacgtagtaagtatttcgacgtacgtttacgtggtacgtacgtaaacgttaggtttactaccgtaacgttaaacccgttacgttaccgttttcgggaacccgtacgggggtaacccaaggtacgtacggtaacgacgttacaaacgttaccggtaaacgtcggtacggtaccttaggaccctaacctacgtttccgtcggtttaccc

SEQ ID NO: 170040 - DNA, 539 bp, Homo sapiens
  misc_feature: GYAE6OF01BA98X.14.30.C08.1.454.CMB.1.raw
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgactacccttttaaattggtatcagcagaagccaagggaaacncccctaaattctgatctatgatgacaacctaatttacaagtatgggactcccatcaaggttcagtggcggtgatcgnggggcgtatttcactctacaccatcagcagtctgaccaacctgaagtattttgacgtacttacgtggtcgtacaacgtagggttactactaacgtaacccgttactacgttttcggaccgtagggaccaaggctacggactagtcaatacgtaactggtacgctcgctaacactctcgtc

SEQ ID NO: 170041 - DNA, 580 bp, Homo sapiens
  misc_feature: GYAE6OF01DJ83Q.14.30.C08.1.454.CMB.1.raw
  modified_base (201)..(201): a, c, t, g, unknown or other
  misc_feature (201)..(201): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggcaagtcaggccattgaactacccttttaaattggtatcagcagaagccagggaaagcccctaaattctgatctatgatgacaaccaatttacaagatggatccatcaagttcagtggcggtgatcgtggggcgatttcgactctcaccatacagctagtctgctaaccgtagaagttatttgaccgtacttacgtaggtgtactaacgtagggttaactacctaacgttaacccgttactaccgttttacgggacccgtacggggaaccaacggtcgtacggaactacgtaaccgtaagtaccggtaaacgttcgggttcggaccttcggacccaccgtactccgtttgttaccc

SEQ ID NO: 170042 - DNA, 707 bp, Homo sapiens
  misc_feature: GYAE6OF01DAG6L.14.30.C08.1.454.CMB.1.raw
  modified_base (107)..(107): a, c, t, g, unknown or other
  misc_feature (107)..(107): n is a, c, g, or t
  modified_base (201)..(201): a, c, t, g, unknown or other
  misc_feature (201)..(201): n is a, c, g, or t
tcagcgtctagtaccacgaccggtgctcgatttagtctgacgtcaaagggaaagggggcaggagtcagtctcagtcaggacacagcgtggacatgagggtcccccgntcagctcctgggctccttctactctggctccgaggtgccagatgtgacatccagatgacccagtctccatcctccctgtctgcatctgtggganacagaatcagcatcacttggccggcaagtcaggcctattgaacctaccttttaaatggtatcagcaagaacgaccgaagggaaacctacccctaaattctagactctatgatcgaacctaaactaatttacaagtagtacgggactaccctagtacgtaaggttcaggtggcggtaggagtcggtaggggtcgtatttcacttcacgtacatcagtctacgtctacgacctaaccgtaggtaacgttacgttttacggaccgttaaccgtttacgttacgggtttacgtaaccgttaacggttaacgggtttaacttaacccgttaaaccgtttaaaccccgtttaacgtttaaccggtttttccgggaaacccgggttaacgggggtaaccctaacggtccggttaccgggaaacttaccgttaacgtaaccggttaaaccggtaacggttcggtacgggtaccgttaccgaacccgtaacccgtagtttccgttaccgtttccg

SEQ ID NO: 170043 - DNA, 621 bp, Homo sapiens
  misc_feature: GYAE6OF01AOVUD.14.30.C08.1.454.CMB.1.raw
  modified_base (276)..(276): a, c, t, g, unknown or other
  misc_feature (276)..(276): n is a, c, g, or t
  modified_base (414)..(414): a, c, t, g, unknown or other
  misc_feature (414)..(414): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgactaccttttaaatggtatcagcagagcaggaaacncccctaaacttctgactctatgatgactaaacctaatttacaagtatagggactacccatacaaggttcaggtggcggtgatcggtggggcgtatttcgactctcaccatcagctagtctagacctaacgtgaagttntttacggacgttacttacgtggtacttacgaacgttacgggtttaactaccgtaacttaaccccggttacttaccgttttacggacccgtaacgggggtaaccctaaggtaccgtacgggaaacctacgttaaccgtaacgttaaaccggtaacgttacgggtacggttccgtacgtacccaacctaacgttcgtttacggttaccc

SEQ ID NO: 170044 - DNA, 599 bp, Homo sapiens
  misc_feature: GYAE6OF01BAX0B.14.30.C08.1.454.CMB.1.raw
  modified_base (281)..(281): a, c, t, g, unknown or other
  misc_feature (281)..(281): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgaccaagtctccatcctccctgtctgcatctgtggggagacagaatcagcatcacttgccgggcaagtcaggccattgactaccttttaattggtatcagcaagagccaagggaaacncccctaaattctgatctatgatgactaaacctaatttaacaaagtagtagggtactacccatacgtaaggttcaaggtcggacgggtggtagttcggtagggggtcgtattttccgaccttctaccaacctatacgacgcgtagttctagacaaccgtagaacgttagtttcgacgtactttacgtggttacgtacgtaacgtagggttactacgtaacgttaacccgttacttacgttttcgaccggtacgggaccacggtcgtaggactagtacagtacgaacgtgtaggactacgacaccgtattcgtcgttacc

SEQ ID NO: 170045 - DNA, 668 bp, Homo sapiens
  misc_feature: GYAE6OF01DPXFX.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctggtgggagacagaatcagcatcacttgccgggacaagtcaggccattgactaccttttaaatggtatcagcaagaagaccgaggaaacgacccctaaacttctagatctatgatacgacaaacctaatttacaagtagtacgggactccatacgaaggttcaggtggacggtagatcggtggggacgtacttacgactcgtacacctatcgacgctagtctacgacctaacgtagtaagttagttttacgacgttaaccgtttacgttaggttacgtaaccgtaaacgttaacggggttaacttaaccgtaaccgttaaaccccggttacgtttaaccgttttacggggaacccggtacggggtaaaccgtaacggtaccgttaaggaaccctaacgttacccgtaaagtaacccggtaaacgttcgggtacgtaccgtacggaacccaacgttacgttccgttcggtttaccc

SEQ ID NO: 170046 - DNA, 557 bp, Homo sapiens
  misc_feature: GYAE6OF01AWJL2.14.30.C08.1.454.CMB.1.raw
  modified_base (201)..(201): a, c, t, g, unknown or other
  misc_feature (201)..(201): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccggcaagtcaggccattgactacctttaaattggtatcagcagaagcagggaaacgcccctaaacttctgatctatgatgacaaccaatttacaaagatgggatcccatcaaggttcagtggcgtggatcgtggggcgtatttcgactctcaccatcagctagtctcgactaaccgtgaacgtattttgacgtactttacgtggttagtacgaacgtagggttatacgtacttaacccgtacgtaccgttttcggactaacgggtaccgaagtcgtaggactacgtctaagttacggtaacgtgtacggtctacgactaacctattccgtgttacc

SEQ ID NO: 170047 - DNA, 603 bp, Homo sapiens
  misc_feature: GYAE6OF01CNCN0.14.30.C08.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
  modified_base (425)..(425): a, c, t, g, unknown or other
  misc_feature (425)..(425): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccggnagtcagcattgacctaccttttaatggtatcgagcagaagccgaagggaacncccctaaatcgtgatctatgatgacaacctaatttaacaagtatcggatcccattacgaaggttcaggtggcggtagtagtcgtaggggcgtatttccgacgtctacacctatcgaagcctacgtctacgacctaacgtgtaacgttntttacggacgtacgtttacgtggttacgtactaacgtaggttactacgtaaccttacccgttacgtaccgttttacggaccggtaacgggtacccaggtccgtaacgggactacgttacgtaacgtaaccggtacgttgtaccggtacttacccgactactttcctcgttcttacccg

SEQ ID NO: 170048 - DNA, 578 bp, Homo sapiens
  misc_feature: GYAE6OF01ETAP6.14.30.C08.1.454.CMB.1.raw
  modified_base (202)..(202): a, c, t, g, unknown or other
  misc_feature (202)..(202): n is a, c, g, or t
  modified_base (283)..(283): a, c, t, g, unknown or other
  misc_feature (283)..(283): n is a, c, g, or t
  modified_base (567)..(567): a, c, t, g, unknown or other
  misc_feature (567)..(567): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctggtggganacagaatcagcatcacttgccgggcaagtcaggccattcgacacccttttaaattggtatcagcaagaagccagggaaacncccccttaaaacttctgatctatgatgcaacaatttaacaagatagggactccatacaaggttcaggtggcggtgaagtcgtggggacggtatttcgactctcactatcgagcacgtctagacaaccgtagtaacgtagttttgacgtacgtttacgtggtacgtacaacgtaggttaactactaacgtaaccccgttactacgttttcggacccgtacgggaaccgtaacggacgtacggactagtccgtaatacgtaacgtcgtaggcttacgacctaaccnttcgtgttacc

SEQ ID NO: 170049 - DNA, 783 bp, Homo sapiens
  misc_feature: GYAE6OF01CGP7I.14.30.C08.1.454.CMB.1.raw
  modified_base (229)..(229): a, c, t, g, unknown or other
  misc_feature (229)..(229): n is a, c, g, or t
tcagcgtctagtaccacgaccggtgctcgatttagtctgacgtcaaagggaaagggggcaggagtcagtctcagtcaggacacagcgtggacatgagggtccccgctcagctccgtggggctccttctactctggctccgaggtgccagatgtgacatccagatgacccagtctccatccctccctgtctgcatctggtgggagacagaatcagcatcacttgccgggnaagtcaggccattgacctaccttttaatggtatcagcagaacgccgaagggaacctacccctaaacttctagacttctagtcgatcgactaacctaatttaacaagtacgtaggaactccagtacgtaaaggttcaggtggcggtgggacgttcggtgggggacgttatttccgaccttccgtaccgtaacctacttaccgacgtaccgtacgttaccgtacgacccttaaaccgttaggtaaacggtttacgttttacggacccgtttaacgttttacggttcgggtttacgtaaccgttaaacgggtttaacggggtttactaacccgttaaaccgtttaaaccccccggtttaacggtttaacccggtttttaccggggaacccggggttaaacggggtaaaccccgtaaagggttacccggtttaacgggaaacccttaacggttaaacccgtaaacggttaaacccggttaaccgggttagggtttaccggggtacccgttacggtaaacccgtcccggtttaaacttccgggtttaacgttttacccg

SEQ ID NO: 170050 - DNA, 641 bp, Homo sapiens
  misc_feature: GYAE6OF01DE3R4.14.30.C08.1.454.CMB.1.raw
  modified_base (205)..(205): a, c, t, g, unknown or other
  misc_feature (205)..(205): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtcctccactccctccctgtctgcatctggtggganacagaatcagcatcacgttcggccgggacaaggtccaggacctagttacgaccttaacctttttaaagtggtaatcgaagacaagaacgccgaaagggtaaccaccccttaaacttcagacttctaagtgactacgactaaacctaatttacaagtagtacgactaccgagtacgaaggttcaggtcggacggtgtacgtcggtgggtactatttacacgtctaccactatacagctacgtcgtacgtaactaacgtagtagttacttcggtacgtacttacgtggtacgtacgtaacgttacgttactaaccgtacttaacccgtacttaccggtttacgacccggtaaggtaaccgtacgtcgtacgactaacgttaccgtaagtaaccgtaggttccgtagtccgtacgacctaacctcgttctcggtttacc

SEQ ID NO: 170051 - DNA, 553 bp, Homo sapiens
  misc_feature: GYAE6OF01BT3GW.14.30.C08.1.454.CMB.1.raw
  modified_base (281)..(281): a, c, t, g, unknown or other
  misc_feature (281)..(281): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctggtgggagacagaatcagcatcacttgccgggcaagtcaggccattcgactaccttttaaatggtatcagcagaagccaagggaacncccctaaattctgatctatgatgacaactaatttacaagtatggactcccatcaaggttcagtggcgtggatcgtggggcgtattcactctcacatcagcngtctgacaactgaatntttgacgtacttacgtgtcgtacaacgtaggttactacgtaacgttaacccgtacgttacgttttcggaccgtacggggaaccaacggtcgtacggacctagtacgtaataccgtacgttggtacggtctacgaccaaccgtcttccgtgttccc

SEQ ID NO: 170052 - DNA, 582 bp, Homo sapiens
  misc_feature: GYAE6OF01A0LPF.14.30.C08.1.454.CMB.1.raw
  modified_base (280)..(280): a, c, t, g, unknown or other
  misc_feature (280)..(280): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgactacccttttaaattggtatcagcagaagccagggaacncccctaaattctagatctatgatgaccaaacctaatttaacaagtagtagggacttacccatacgtaaggttacaggtggcggtgatcgtggggtcgtatttcgactctacaccatcagcctagtctagaccaaccgtagtaaacgttattttcgcgttaactttacgtggttactacgtaaacgttagggttaactactaaccgtaacccgtactaccgttttcggacccgaggggaaccaggtctaggaactacgtacaagtacgtaactggtagtacgtacgacacctatcgttgttcc

SEQ ID NO: 170053 - DNA, 513 bp, Homo sapiens
  misc_feature: GYAE6OF01E1P0Q.14.30.C08.1.454.CMB.1.raw
  modified_base (277)..(277): a, c, t, g, unknown or other
  misc_feature (277)..(277): n is a, c, g, or t
  modified_base (369)..(369): a, c, t, g, unknown or other
  misc_feature (369)..(369): n is a, c, g, or t
  modified_base (504)..(504): a, c, t, g, unknown or other
  misc_feature (504)..(504): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacaccctttaaatggtatcagcagaagccagggaaanccccctaaattctgatctatgatgcaaccaatttacaagatgggatcccatcaaggttcagtggcggtggatcgtggggcgtatttcactcncaccatcagcagtctgcaacctgaagtatttgcgtactttactggtgtacaacagggttatacataacccgtactacttttcggaccgtagggaccaagctaggaaccatcaatacgtaactgtggctgacaccncttctgttc

SEQ ID NO: 170054 - DNA, 637 bp, Homo sapiens
  misc_feature: GYAE6OF01ED2IF.14.30.C08.1.454.CMB.1.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcactgccgggnaagtcaggccattgactaccctttaaatggtatcagcagaagcaagggaacnccccttaaatctagatctatgatgacaactaattacaagatgggatacccagtacaaggttcaggtggcggtggacgttcggtggggcggtatttccgacttctacaccgtatcgagacacgttctacgacctaacgtagtaaagttgttttacgaccgttaccgtttacggttggttacgtaaccgtaacggttaacgggtttaataaccgtaaccttaacccggttaaccttaaccgtttttacgggacccggtaacggggtaaccgaacggtaccgttacgggtaacacggttaccaaggttaaccggtaaccgtggtacggcgtacggaccctaaccgtacttcgttcggttaccc

SEQ ID NO: 170055 - DNA, 654 bp, Homo sapiens
  misc_feature: GYAE6OF01DAY1I.14.30.C08.1.454.CMB.1.raw
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatccctccctgtctgcatctggtgggagacagaatcagcatcacttgccggnaagtcagcatgacaccttttaatgtatcancagaagccaagggaaacgcccctaaaacttctagacttcgtatgatgaccaaacctaaatttacaaagacttagggaactcccagtaccaaggttcaaggtggcggtggattcggtggggtcggtatttcgacgttctcaaccatcagctagtctgacctaactgtaaagtattttcggaccgtaacgtttacgtgggttactaccgtaaacgtaggggtttaacctaccgtaacgttaaaccccggttacttaacccgtttttcggggaaccccgtaagggggtaacccctaaagggtacccgttagggaaccttaaccgtactaacgttaaccggtaaaccggttcggttacgggctttaccggaccctaaccgtaccttaccttggtttacccc

SEQ ID NO: 170056 - DNA, 660 bp, Homo sapiens
  misc_feature: GYAE6OF01DJ1SU.14.30.C08.1.454.CMB.1.raw
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
tcagcgtctagtaccacgaccggtgctcgatttagtctgacgtcaaaagggaaagggggcaggagtcagtctcagtcaggacacagcgtggacatgagggtcccccgctcagctccgtggggctccttctactctggctccgaggtgccagatgtgacatccagatgacccagtctccatcctccctgtctgcatctgtggganacagatcagcatcacgtggccgganaagtcaggcctattcgacctaccttttaaatgtatcagcaagagccaagggaactcccctaaattctagatctatgatcgacaacctaattacaagtataggactaccatacgtaaggttcaggtcgggtacggtaggtacgtcggtgggggtaccgttactttccgaacttccgtaccgtaacctacgtacgaacgtaccgtaacgttcctacgtaaccctaaaccgtaggtaaacgtttacgttttcggtaaccgtacgtttacgtcggtttaacgtaccgtaaagttacgggtttaactaccgtaaccgttaaacccgttacgttacgttttacggaccggtaaccgggaacctaacggtcgtacgaactaacgttacgaacttaccgtaagttggcgtacgtacgtaccacctacttcgtcgttacc

SEQ ID NO: 170057 - DNA, 557 bp, Homo sapiens
  misc_feature: GYAE6OF01EYAUO.14.30.C08.1.454.CMB.1.raw
  modified_base (387)..(387): a, c, t, g, unknown or other
  misc_feature (387)..(387): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccggcaagtcaggccattgactacccttttaaatggtatcagcagaagccgaagggaaacgccccctaaaacttctagactctatgatgacaacctaatttacaagatagggactcccatcaaggttcagtggcgtggatcgtggggcgatttcactctcacatcancagtctgcaacctagaagtatttagacgtacttacgtgtcgtacaacgtaggttatactaactaacccgttactaccttttcgggaccgtacggggtaccaacgtccgtacggtaaccacgtacaagtacgaactcggtggacctacggacaaccctattccgtgttacc

SEQ ID NO: 170058 - DNA, 604 bp, Homo sapiens
  misc_feature: GYAE6OF01EX0OP.14.30.C08.1.454.CMB.1.raw
  modified_base (226)..(226): a, c, t, g, unknown or other
  misc_feature (226)..(226): n is a, c, g, or t
  modified_base (362)..(362): a, c, t, g, unknown or other
  misc_feature (362)..(362): n is a, c, g, or t
  modified_base (459)..(459): a, c, t, g, unknown or other
  misc_feature (459)..(459): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggnaagtcaggccattcgactacccttttaattggtatcagcagaagaccgaagggaaacgacccccttaaacttctagtatctatgatgacaaacctaatttaacaagatagggactcccatacaaggttcagtcggngtggatcggtggggcgtatttcacgttcctcacctataccagctagtctagacctaaccgtagtaacgttagttttgaccgttacttacgttcggtnttacgtaacgtaggttactacgtaacttaacccgttacttacgttttacgggaccgtacggggaaccaacggtcgtagaacctacgtacgtaagtaaccgtacgttgggtcgaccgttacggaccaacctacttcgttgttaccc

SEQ ID NO: 170059 - DNA, 563 bp, Homo sapiens
  misc_feature: GYAE6OF01BDL2K.14.30.C08.1.454.CMB.1.raw
  modified_base (281)..(281): a, c, t, g, unknown or other
  misc_feature (281)..(281): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (427)..(427): a, c, t, g, unknown or other
  misc_feature (427)..(427): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgactacccttttaaattggtatcagcagaagcaaggggaacncccctaaattctgatctatgatgacaacctaatttacaagatgggactccatacgaagttcaggtggcgtggatcgtggggcgtatttcactctcacntcancgatcngaccaactgaacgtattttcgacgtacttagttcggtntacgaacgttaaggttaactacctaacgtaaccccgtttaactaccgttttcggcccggtaagggaccctaaggcctaggacagtcctaatacgaaccgttaggtcggtactacggacaacctctccgttgttacc

SEQ ID NO: 170060 - DNA, 589 bp, Homo sapiens
  misc_feature: GYAE6OF01EQ6H6.14.30.C08.1.454.CMB.1.raw
  modified_base (226)..(226): a, c, t, g, unknown or other
  misc_feature (226)..(226): n is a, c, g, or t
  modified_base (574)..(574): a, c, t, g, unknown or other
  misc_feature (574)..(574): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgtcagatgtgacatccagatgacccagtctccatccctccctgtctgcatctgtgggagacagaatcagcatcacttgccggnaagtcaggccattgactaccctttaaatggtatcagcagaagccagggaacgcccctaaatctagatctatgatgacaacctaatttacaagtatgggactcccatacgaaggttcaggttggcggtggactcgtggggcggtatttcacgtctcaaccatcagcacgtctagacctaacctagtaagtattttcggacgtacttacgttggtacgtacaacgtagggttaactacaacgttaacccgtactaccgttttcggacccgaggggtaaccaacggtcgtacggtaacacgtactaagttaaccggtaacttcggtacggccgttacggacctaacccgtnttccgtcggttaccc

SEQ ID NO: 170061 - DNA, 608 bp, Homo sapiens
  misc_feature: GYAE6OF01DSEMO.14.30.C08.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccggnaagtcaggccatgactacctttaaatggtatcagcagaagccaaggaaacgccccttaaacttctgatctatgatgacaacctaatttaacaagtatagggactacccataccgtaaggttcaggtcggcggtggatcggtggggcgtatttcaccttctacaccatacagctagtctgactaactgaacgttatttgtaccgtactttacgtggttacgtactaacggttagggttataccgtaacttaacccgttacgttaaccgttttcgggaaccgtacggggtaaccaacggtcgtacggtaccaacgttaccgtaaagttaaccggtaacttgggtacggtacgtacggacctacccgtacttccgttcggttaccc

SEQ ID NO: 170062 - DNA, 796 bp, Homo sapiens
  misc_feature: GYAE6OF01DZWQ8.14.30.C08.1.454.CMB.1.raw
  modified_base (106)..(106): a, c, t, g, unknown or other
  misc_feature (106)..(106): n is a, c, g, or t
  modified_base (163)..(163): a, c, t, g, unknown or other
  misc_feature (163)..(163): n is a, c, g, or t
  modified_base (749)..(749): a, c, t, g, unknown or other
  misc_feature (749)..(749): n is a, c, g, or t
tcagcgtctagtaccacgaccggtgctcgatttagtctgacgtcaaagggaaagggggcaggagtcagtctcagtcaggacacagcgtggacatgagggtccccgntcagctcctggggctccttctactctggctccgaggtgccagatgtgacatccagancgacccagtctccactccctccctgtctgcattcgtggtgggacacagaatcaagctaagtctacttcggaccgggtacaaggttccgaaggtccctaagttacgtaaacccttaaacccgtttttaaagtacggttactacgaacggacaaaggaacgtaaccgaaacggggtaaacctacccccgttaaaactttccgaagtaacttcttaagacgtacgttaccgaacctaaaaccgtaaaattttaccgaaaggtagtttacgggacttaccctaagtacgtaacggttacgaagggtcggtaggtacggtaatccgggtagggggtaccttaagttttacccaacgttacgttcccgaaccttacgtacggaacgtaccgtagtaccgtacgtaacccttaacggtagtaaacgtttacgttttacggacgtttaacgtacgttacggttaacgtaacgtaacggtaaggttaccttaaaccgtaaccgttaacccgttaccgttaccgggtttacggaacccgttaacgggaacctaacggtccttacggaaccttagtaaccgtaacgaacgttaccgngttaccgggacttaccggacccttaagtaccttcggtacctttaccg

SEQ ID NO: 170063 - DNA, 799 bp, Homo sapiens
  misc_feature: GYAE6OF01DT95B.14.30.C08.1.454.CMB.1.raw
tcagcgtctagtaccacgaccggtgctcgattagtctgacgtcaaagggaaagggggcaggagtcagtctcagtcaggacacagcgtggacatgagggtccccgctcagctcctggggcttccttctactctggctccgaggtcgccagatgtgacatccagatcgaccacgtcctcctactccctcctgtctgctatcgtggtggacacagtaactcagctatcgtacgtcggccggacgtacgtacgtacggtacctagttaccgtaccttaacctttaagttaggtacagtacgacgaaggaacgaccggtaacggtaaccgtaacccctttaacttagtacgtacttacgtacgtgtaaccgtaacctaaccgttaacctaaacgttaacgttaacgggtaacgttaccgtaacgtttaccccaaagggtttaccgtaacgggttacggtaacggggttacgggtacggggttacggttacggggttaccggtaccggggtttaccgtaaccgtttcccggtaactaccccggtactacctaccgtactacggtaccgttggttaaccgtacgtaaccgttaacgtacgtttaacggttacgttaccttacggttaccgtttaggttaccggttacgtaacggttaacgttacggttaaacctaccgttaaccgttaccggttacgtaccgtacgggtaaccggtacgaacgtagtacgtaccgtagtaaccgtaccgttaaggtacgttacggacgtcgtacgtacctacgttacttcttccgtcgttaccccg

SEQ ID NO: 170064 - DNA, 682 bp, Homo sapiens
  misc_feature: GYAE6OF01BX7L8.14.30.C08.1.454.CMB.1.raw
  modified_base (203)..(203): a, c, t, g, unknown or other
  misc_feature (203)..(203): n is a, c, g, or t
tcagcgtctagtaccacgaccggtgctcgatttagtctgacgtcaaagggaaagggggcaggagtcagtctcagtcaggacacagcgtggacatgagggtcccccgctcagctcctggggctccttctactctggctccgaggtgccagatgtgacatccagatgacccagtctccatcctccctgtctgcatctggtggganacagaatcagcatcacttcggccgggacaagtcaggcctattcgacctacccttttaaagtggtatcagcaagaacgccgaagggaaacacccctaaattcgtagtacttactagtcgatacgacctaaaacctaagtttaacaaaggtagtagggaacctcccaatacgtaaggttccagggtggtacgggtggtaacgttcggtgggggtaccggtacttttcgaccgttcctaccaacccgtatacgacgtaccgtaacgttccgtacgtaccgtaaaccgttaggtaacgtttacgtttacggaccgttaacgtttacgtggttacgtacgtaaacgttagggttaactaccgtaaacgttaacccgtacgttacgtttacggaccgtacgggaacctacggtcgtacggaactacgtacgtataacggtactggtacggtctacggacctaaccgtacgttccgttacgttacg

SEQ ID NO: 170065 - DNA, 859 bp, Homo sapiens
  misc_feature: GYAE6OF01BC0L4.14.30.C08.1.454.CMB.1.raw
  modified_base (106)..(106): a, c, t, g, unknown or other
  misc_feature (106)..(106): n is a, c, g, or t
  modified_base (145)..(145): a, c, t, g, unknown or other
  misc_feature (145)..(145): n is a, c, g, or t
  modified_base (205)..(205): a, c, t, g, unknown or other
  misc_feature (205)..(205): n is a, c, g, or t
tcagcgtctagtaccacgaccggtgctcgatttagtctgacgtcaaagggaaagggggcaggagtcagtctcagtcaggacacagcgtggacatgagggtccccgntcagctcctggggctccttctactctggctccggaggtnccagatgtgacatccagatgacccagtcctccatccctccctgtctgcatctggtggganacagaatcagcatcacttggccggacaagtcgacggacctattcgtaacctaaccctttttaaagttggtatcgtaagctaaggaacgtaccgaaggggaaaacctaccccccttaaaagtttcctaggtaacttaccgtaagttacggtaacttaccggtacctaaaacccgttaaatttttaaaccgaaaggttaaggttaacggggtaacccttacccccgtaaagttaacccggtaaaaggggtttcccgtaaggggttacggggtacggggtttacggggtaacgttccggggttacgggggggtacccgttaaacgttttttcccgaaacccgtttacccgtaacccgttaaccgtaacttaccggtaacgtaccggttacgttaccgttacccgtaaacccgttaaaccgtacggtaaaacggttttagttttaacgggtaccgtttaaaccgtttttacggtacgggttaccgttaaccgtaaacggttacggggtttaaccacgttaaccgtaaccccgttaacgttaccgtttacgggaccgtacgggaacctaacggccttaaggtaacctacgtaccgttaacggtacctaaacgttgtacggtaccgtacacccgtaacgttccttacgttacggttaccc

SEQ ID NO: 170066 - DNA, 828 bp, Homo sapiens
  misc_feature: GYAE6OF01BMYFD.14.30.C08.1.454.CMB.1.raw
  modified_base (203)..(203): a, c, t, g, unknown or other
  misc_feature (203)..(203): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtcctccatccctcctgtctgcatctggtggganacagaatcgagctactctacgttcggcccgggacaacgtcgacggtacctagttacgtaaccctttaaacccgtttttaaagttcggttaactaccgtaacggaccgaaacggtaaaccggtaccccgggtaaaacggggtaaaaccccgttaacccccccgtttaaaaacgttttccggtaacgttaacgtttaccggttaaacgttacggtaaaccgttaccggtaaaacccttaaaacccgtttaaaaacgtttttaaacccggaaaagggtacggtttaaaccgggaacccttaacccccgttaaagttacccggttaaaacgggtttcgtaaacggggttcgggtacggggttacggtaacggttcggggtacgggggtaccgtttacttccgtaccgtccgtacccgtaacctacgtaccgacgtcgtacgttcgacgacctaacgtacgttaagttcgtttacgacgttaccttaggtcgttataccgtaaggttagtactaccgtaacgttaacccgttacgttacggttacggaccggtaggacctaggtactaggaacctagtaccgtaagaacggtcgttggtaccgtctacgactacttgttccgtcgttacc

SEQ ID NO: 170067 - DNA, 663 bp, Homo sapiens
  misc_feature: GYAE6OF01BIB29.14.30.C08.1.454.CMB.1.raw
  modified_base (106)..(106): a, c, t, g, unknown or other
  misc_feature (106)..(106): n is a, c, g, or t
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (288)..(288): a, c, t, g, unknown or other
  misc_feature (288)..(288): n is a, c, g, or t
tcagcgtctagtaccacgaccggtgctcgatttagtctgacgtcaaagggaaagggggcaggagtcagtctcagtcaggacacagcgtggacatgagggtccccgntcagctcctggggctccttctactctggctccgaggtgccagatgtgacatccagatgacccagtctccatccctccctgtctgcatctggtgganacagaatcagcatcacgttgccgggntaagcaggcctagttcgactacccttttaaatggtatcagcaagacgaccaagggaaacncccctaaattctagatctatgatcgaccaactaattacaagagtaggactcccaatacgaaggttcgaggtaggcggtggtaacgttcggtggggacggttacttttaccgacttccgttaccaaccgtactacgtaacgccgttaacgtccgttaccggaccgtaacccgttaggtaaacggtttacgttttacggtaccgttaacgtttacgtggttaccgttacgtaacggttagggttaactaaccgtaacgttaacccgttaacgttacgtttacggacccggtaacgggtaccgaaggtccgtagaccgtaacgtcgtaacgtacgtacgtcgtagtccgtacgtacccgtactgttccgtcgttaccc

SEQ ID NO: 170068 - DNA, 666 bp, Homo sapiens
  misc_feature: GYAE6OF01DIN03.14.30.C08.1.454.CMB.1.raw
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (319)..(319): a, c, t, g, unknown or other
  misc_feature (319)..(319): n is a, c, g, or t
tcagcgtctagtaccacgaccggtgctcgatttagtctgacgtcaaagggaaagggggcaggagtcagtctcagtcaggacacagcgtggacatgagggtccccgctcagctcctgggctccttctactctggctccgaggtgccagatgtgacatccagatgacccagtctccatcctccctgtctgcatctggtgggagacagaatcagcatcacttgccggnaagtcagccatgactaccttttaaatggatcagcagaagccagggaaacncccctaaattctagatctatgatgacaacctaatttacaaagtntagggactccaatcgtaaggttcaggtcggacggtgtaagtcggtagggggcgttatttccgaacttcctacaacctagtaccgtaggtacctaggttcctacggtacctaaacccgttaggaaacgtttagttttacggaccgttaacgtttaccgttgggtacgttaaccgaacgttaacggggttaacttaccgtaaaccgtttaaccccgttagtaaccgtttttacgggacccgtaacgggggaccctaaagggtccgtacgggtaactacgtaaccgaagtttaaccggaaacgttcggtacgggacgttacgaccctacccgtaattccgttgtttaccc

SEQ ID NO: 170069 - DNA, 602 bp, Homo sapiens
  misc_feature: GYAE6OF01DY2XS.14.30.C08.1.454.CMB.1.raw
tcagcgtctagtaccacgaccggtgctcgatttagtctgacgtcaaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctggtgggagacagaatcagcatcacttcgccgggacaagtcaggccattgactaccttttaaatggtatcagcagaagccgaagggaaacgaccccctaaacttctagatctatgatcgacaacctaatttaacaagtagtagggactacccaatacgtaaggttcaggtcgggcgggtggagtcggtggggcgtatttcactctactaccatcgagcagtctacgacctaactgaagttatttcgtaccgtacgtttacgttggttacgtacgtaacgtacggtttaactacctaacgttaacccgttacgttaccgttttcggaccggtacgggtaaccgtacgtacgtaggactacgtactaagtaacggaacgtgtacggactcgaccactactcgtcgttacg

SEQ ID NO: 170070 - DNA, 622 bp, Homo sapiens
  misc_feature: GYAE6OF01D2OWR.14.30.C08.1.454.CMB.1.raw
  modified_base (201)..(201): a, c, t, g, unknown or other
  misc_feature (201)..(201): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggcaagtcaggccatgactacctttaaatgtatcagcaagaacgccaagggaaactcccctaaattctagatctatcgatacgactaaactaaatttaacgaaagtacgtagggaactacccaatacgtaaaggttcgaaggtgggaccgggtaggaacgttcggtacgggggtcgttaatttccaacttcctactaaccacgttacaagactacgttctacgtaccaacttagaagttatttacgtacgttattacgtggtacgtaacgtaacgtaagggttaactacttaacgtaacccgttacttaaccgtttacggacggtaacgggactaaagcgtacggactacgtactaagtaacgtaacgtggtcggacttacgacacctatcctgttacc

SEQ ID NO: 170071 - DNA, 638 bp, Homo sapiens
  misc_feature: GYAE6OF01BE7S8.14.30.C08.1.454.CMB.1.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
  modified_base (532)..(532): a, c, t, g, unknown or other
  misc_feature (532)..(532): n is a, c, g, or t
  modified_base (592)..(592): a, c, t, g, unknown or other
  misc_feature (592)..(592): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatccctccctgtctgcatctggtgggacgacagaatcagcatcacgttgccggcaagtcaggccattagaacctaaccttttaaatgtatcagacaagaacgcgaaggaaacncccctaaattcngactnanagtnacanaacttataanagtnanacacanatagtatgngtgngtnggcgattacgtcactcgtacactacgngtacgatcgtacncgaaaccagttaagtacgtttacgtgtaaccttacggtttagcggttaaacgtaaacacggggttaacgtttaccaacgttaaaccccggttacgttaacccgtttaggttacccggaacggggtaaaccgggtaaacnccggttaaggtacctaacggtaacttaaccggaaacggtttaaacccgagttaccgggtntaaacccgttcggtaaacccctattaccgtttggttcccctaaacg

SEQ ID NO: 170072 - DNA, 645 bp, Homo sapiens
  misc_feature: GYAE6OF01EIQU6.14.30.C08.1.454.CMB.1.raw
  modified_base (201)..(201): a, c, t, g, unknown or other
  misc_feature (201)..(201): n is a, c, g, or t
  modified_base (611)..(611): a, c, t, g, unknown or other
  misc_feature (611)..(611): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccggcaagtcgacggccattcgacctaacccttttaatggtatcagcagaacgcaagggaactcccctaaattcgagactcttatgatacgacctaaacctaatttaacaagtacgtcgggacctaccaagttacgaaacggttcgaaggtcgggtcggttcggacgttcggtgggggtaccgttatttccgacttcccgtactacctacgtctaacgcgtacgttcacgtacctaaccgttgtaacgttagttttacgacgttactttagtgggttctaaccgaggttacggttacttaccgtaacgtttaaccgtaccgtttaagtttccgggaaccggtacgggtaacccaggtaccgtacgtaactaccgtacgtaagtaacccgtntccggtatcgtccaccgtagtacttgtcgttacc

SEQ ID NO: 170073 - DNA, 656 bp, Homo sapiens
  misc_feature: GYAE6OF01A8CZP.14.30.C08.1.454.CMB.1.raw
  modified_base (106)..(106): a, c, t, g, unknown or other
  misc_feature (106)..(106): n is a, c, g, or t
tcagcgtctagtaccacgaccggtgctcgatttagtctgacgtcaaagggaaagggggcaggagtcagtctcagtcaggacacagcgtggacatgagggtccccgntcagctcctggggctccttctactctggctccgaggtgccagatgtgacatccagatgacccagtctccatccctccctgtctgcatctgtgggagacagaatcagcatcattgccgggcaagtcaggccaattgactacctttaaatggtatcagcagaagcagggaacacccctaattctgaattcaatgatagaccaaacctaagtttacaaagtagttagggactacccgtaagtaccgtaaaggttcaacggttgggcggtaggtaagtcggtaggggtcggtaatttccgacttaccgtacaacctattccgaagtacgacgttactacgacccgtaacgtagtaaaggttacgttttacgaccggtacgtttaacgttcgggtagttaacgtaaacggttaacggttaacgtaccttaaccgttaaacccgttaccgttaccgttttagacccggtaagggaaccctaacggtacttaccggaatacgtactaacggtaacctaacgtcgttacgccgttacgaccatacgtccttcgttacc

SEQ ID NO: 170074 - DNA, 713 bp, Homo sapiens
  misc_feature: GYAE6OF01C3E69.14.30.C08.1.454.CMB.1.raw
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (652)..(652): a, c, t, g, unknown or other
  misc_feature (652)..(652): n is a, c, g, or t
  modified_base (670)..(670): a, c, t, g, unknown or other
  misc_feature (670)..(670): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatcgaccagtctccatccctccctgtctgcactntggngggagacaagaancagcatcgacgttcggccgggacaaacggtcaggacctaagttacgtaacccttaaccctttttaaagtacggtatcgagacgaagaacgacgaaacgggaaactaccccttaaacttctagtactacgtattgacgtacaacctaaaccgttaaatttaaacaaaggtaacgttacgggaacctaccctaagtaacggtaacggttagtacgggtagggtcgggtagacggttcggtacggggtacgtactttctaccgttcacgtaccatcaacgcgtaagttcacggtaacctaacgtagtaattcgtttacgaacgttccgttagtgtaacgtacgaaacgtttaggtactaaccgtaaccttaacccgtacgtttaacggtttcggaaccgtaacgggtaaacccgagtacgtacgtaaactacgtaccgttaanaacccggtagtttacggnggttacctaccggaacctaacggtcgttaccttccgtttaccc

SEQ ID NO: 170075 - DNA, 881 bp, Homo sapiens
  misc_feature: GYAE6OF01ASPAW.14.30.C08.1.454.CMB.1.raw
  modified_base (202)..(202): a, c, t, g, unknown or other
  misc_feature (202)..(202): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatcgtgtggganacagatcagcatccacttggccggcaagtcaggccaagtcgacctaacccttttaaagttggtatcagcaagaacgaccgaagggaaaccgtacccctaaaacgttcgtagattctaatgatcgactaaacctaatttaacaagtagtacgggtactacccgtaatacgtaaagggtttaccgtaagggttcgggtacggggttacgggtaacgttccggggttacggggggtaccggtttaacgtttttacccggtaaccctttcccgttaacccgtaaacccgttaacgtaaccggtaaccggtaccgttaaccgtttaccggttaacccggaacccgtaaacccgtttaacggtaaaacgggtttacgttttttaacccgggtacccggtttaaacgttttaacccggtttagggttaaccggttacccggtaaaaccggtttaaacggggtttaacctttaacccggtaaacccgtttaaaacccccgggtttaaccgtttaacccgttttttaacccgggggaacccgggtaaaccgggggtaaccccgtaaacgggtacggttaaaccggggaaccttaaccgttaaccgttaaacgtaaacccggtttaaccgtacggggtaccgtaccgtaccgggaccctacccgtaacgtttcccgttcgtttaccccg

SEQ ID NO: 170076 - DNA, 621 bp, Homo sapiens
  misc_feature: GYAE6OF01CU4AH.14.30.C08.1.454.CMB.1.raw
  modified_base (107)..(107): a, c, t, g, unknown or other
  misc_feature (107)..(107): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (406)..(406): a, c, t, g, unknown or other
  misc_feature (406)..(406): n is a, c, g, or t
  modified_base (517)..(517): a, c, t, g, unknown or other
  misc_feature (517)..(517): n is a, c, g, or t
  modified_base (611)..(611): a, c, t, g, unknown or other
  misc_feature (611)..(611): n is a, c, g, or t
tcagcgtctagtaccacgaccggtgctcgatttagtctgacgtcaaagggaaagggggcaggagtcagtctcagtcaggacacagcgtggacatgacgggtccccgntcagctccgtgggctccttctactctggctccgaggtcgccagtatgtgacatccagatcgacccagtcctccatccctcctgtctgcatcgtggtgganacanatcagcatcacgtgcggcagtcagctatgaccttactttaatcgatacagcaagactacgaaggaacctaccctaacttctagtatctatagatcgtactaacttacttaacagcgtaggactaccgtattacgtaaggtcgtaggtcggtaggtacggtactcgggtcgggacgtttatttaccgacgttaccnctaactacttacgagtccgtactcgtaactccgtaaacggttgtaacgttcgttacgtacgttacttgtacggttacaactaaggttagtactacgtaacttaacccgttnttacgtttcggaccggaacggtaaccgtacgtacacggtacctagtacgtaactaaccggtgttacgccgtcgtacccgttaccaatcccgttnttaccggtcc

SEQ ID NO: 170077 - DNA, 611 bp, Homo sapiens
  misc_feature: GYAE6OF01EBMV5.14.30.C08.1.454.CMB.1.raw
  modified_base (108)..(108): a, c, t, g, unknown or other
  misc_feature (108)..(108): n is a, c, g, or t
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
tcagcgtctagtaccacgaccggtgctcgattttagtctgacgtcaaaagggaaagggggcaggagtcagtctcagtcaggacacagcgtggacatgagggtccccgntcagctcctgggctccttctactctggctccgaggtgccagatgtgacatccagatgacccagtctccatccctcctgtctgcatctggtggganacagaactcagcatcacgttcggccggacaagtcgacggcctagttcgaaccttaccttttaaagtggtactcgagcagaacgcgaagggaaccnccccttaaattcagacttctatgatcgactaactaattacgaagagtcggactccagtacgtaaggttcgaggtcggcggtggacgtcggtaggggcgtatttcacttctaccactactcagtacgtcgtctacgacctaacgtagtaacgttagtttcgacttacgttacgtcggtactacgtacgtacgttactacgtaacgttaacccgttacgttacgtttcggacgtacgggaccacgtcgtacgactacgtaccgtaatacggtacgttacgtcgtctaccgactacctacgttcgttcgttacccg

SEQ ID NO: 170078 - DNA, 703 bp, Homo sapiens
  misc_feature: GYAE6OF01D079C.14.30.C08.1.454.CMB.1.raw
  modified_base (106)..(106): a, c, t, g, unknown or other
  misc_feature (106)..(106): n is a, c, g, or t
  modified_base (342)..(342): a, c, t, g, unknown or other
  misc_feature (342)..(342): n is a, c, g, or t
  modified_base (417)..(417): a, c, t, g, unknown or other
  misc_feature (417)..(417): n is a, c, g, or t
  modified_base (527)..(527): a, c, t, g, unknown or other
  misc_feature (527)..(527): n is a, c, g, or t
tcagcgtctagtaccacgaccggtgctcgatttagtctgacgtcaaaagggaaagggggcaggagtcagtctcagtcaggacacagcgtggacatgagggtccccntcagctccgtgggctccttctactctgcgtccgaggtcgccagatgtagacatccaagatcgacccagtcctccacttccctcctgtctagctcttcgtggtagggaacaacaagaactcgacgactactctaacgtccggaccggactaacgcgacgacctaagttacgtaaccttaaccgtttaagtgtactacgagacaacggacgacgaaacggtaacctaccttaacgttnagtactacgtatagtactacgaactaacttaactaagaacggtacgtaaccgtactacgagttaacgtacggtanacgggtgcggtaggtcgtacggtggggtacttacgtctaccgtctaaccgtactcgtacggtactccgtaagtccgtaacgtacgtaacgttagtaactttcggttaacncgttacgtagttccgttaacgtaagtaacgttaacgtacctaaccgacgttaacccgtaagtttacggacgggttaacgaacggtactacgtaccggtaagaaccgtacgtaacctaaggtacccgagttccggtagtacccgagtacccttaatccgttcgttacggtttacccc

SEQ ID NO: 170079 - DNA, 628 bp, Homo sapiens
  misc_feature: GYAE6OF01DAZXO.14.30.C08.1.454.CMB.1.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
tcagcgtctagtaccacgaccggtgctcgatttagtctgacgtcaaaagggaaagggggcaggagtcagtctcagtcaggacacagcgtggacatgagggtcccccgctcagctccgtggggcctccttctactcgtggctccggaggtgccagatgtgacatccaagatcgacccagtcctccatccctcctgtctgcactcgtggtggganacagatcagctatcgacgttcggccgganaagtcgacggcctattacgaaccttaacccttttaaagttgtactacgagacaagtaacggaccgaacggtaaaccgtaccccttaaacttctagtacttactagttacgacgtacgtaacctaaaccttaagttaacaaggtacgtacggaccttaccgatacgtaacggttcgaggtcggcgtaggtcgtcggtgggtcgtacttcgactcgtacacgtatcagtcgtacgtcacgtactaacgtagtatacgtttcgacgttacgtacgttgttacaacgtacggttagtacttacgaaccttaccgtactacggttcgaacggtagaccgagtcgacgtacacgtacagtacgtagtcgcgtacacgacactctgtcttacg

SEQ ID NO: 170080 - DNA, 689 bp, Homo sapiens
  misc_feature: GYAE6OF01B9L7G.14.30.C08.1.454.CMB.1.raw
  modified_base (281)..(281): a, c, t, g, unknown or other
  misc_feature (281)..(281): n is a, c, g, or t
tcagcgtctagtaccacgaccggtgctcgatttagtctgacgtcaaagggaaagggggcagggagtcagtctcagtcaggacacagcgtggacatgagggtccccgctcagctcctggggctccttctactctggctccgaggtgccagatgtgacatccagatacgaccagtctccatcctcctgtctgcatctggtgggacgacagaatcagcactcacgttcggccgggtacaagtccgagcctattacgaccttaaccttttaaagttgatacacgnaacgaacgacgaacgggaaacctacccctaaagttctacggtacttacgtattacgacttacgaacctaaaccttaatttaaacgaaggacgtaggtaaccctaccgacgttacgtaacggttcgtagggtccggtagggtagtaacggtcggttggggtaccgtacgttccgacttacctacaaccgtcttacgacgtccgtaacgtctacggtaacctaacggtagttaacgttagtttacgtaaccgttaacgtttagtacgggtaacttacgtaacgttagtaacttaactaacccgtacgttacgttacgttacgggaccacgggacctagtacgaggactacgtcgtaagtacgttacgacgttgaccgttacgacctacgttacgttccgttaacgttccg

SEQ ID NO: 170081 - DNA, 596 bp, Homo sapiens
  misc_feature: GYAE6OF01B63E8.14.30.C08.1.454.CMB.1.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (387)..(387): a, c, t, g, unknown or other
  misc_feature (387)..(387): n is a, c, g, or t
  modified_base (583)..(583): a, c, t, g, unknown or other
  misc_feature (583)..(583): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcactgccggnaagtcaggccattcgactacctttaatgtatcagcagacgcaggaacncccctaaatctgactctagtcgatcgactaacctaatttacaagtacgtcgggactacccgatacgaagttcaggtcggcggtgactcgtggggcgtattcgactctacacctancgacgtcagtctacggactaaccgtgtaaagttacgtttacgaccgtacgtttacgtggttagtacgtaacgtaggttaactacgtaacgttaacccgtacgttaccgttttacggacccggtagggtaacctaaggtacgtacggaactacgtacgtaacgtacggtacgttcggtacggtctcggactaccctntacgttcgttccc

SEQ ID NO: 170082 - DNA, 755 bp, Homo sapiens
  misc_feature: GYAE6OF01A4X3T.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatccctcctgtctgcatctgtcggagacagaatcagcatcacgttcggccgggtacaacgtcgacggtccaattacgtaaccgttaaccctttttaaagttgggttaactcgaacgtacgaaggtaacgaccggaaacggggtaaaacctacccccttaaaacgttcgtaaggtaacttccgtaatagtaatacgtacctaaaaccgtaagtttaaccgaaaggtacgtacgggtaacttaccccgtaattacggtaaacggtttcgaagggtacggtacgggtacggtacggttacgggtcgggggtaccgtagtttccacttaccgtccgtaacgtacgtacgacgtacgtaacgttaccgtacgaaccgtaacgtacggtaaagtttaccgttttaacggtacgttaaaccgttcggttacggtacgtaacgtaacggttaaggttaactacgttaaaccgtaacccgttacgtaccgtttacgggaccgtacgggtaaccagtacggtacgtaacgtacgtaccgtaagtacccgtatacggtagtacgtacgacctactacttcgttggttaccc

SEQ ID NO: 170083 - DNA, 703 bp, Homo sapiens
  misc_feature: GYAE6OF01B3WOV.14.30.C08.1.454.CMB.1.raw
  modified_base (204)..(204): a, c, t, g, unknown or other
  misc_feature (204)..(204): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatcgacccagtctccatccctccctgtctgcatctggtggganacagaatcagctatcacgttgaccgggactaagtcgaggcctattacgaccttaaccttttaaagtgtactcagacaaggaacgaccgaacggggtaaacctaccccttaaaatcgtacgacttacgtatagacgtacgactaaaaccgtaatttaacgaagtagttacggtaactttaccgaagttacgtaaaggtttcgtaacgggtacgggtacgggttacggtaaggttccggggtaacggggtcgtttaactttacccgtaccgtccttaacccgtaaccgtacgtaccgaacgtacctacgttacgtaccgacctaaccgttacgtaagtttacgttacgtacgttaacttacgtaggtactaacgtaacgtagttactaccgtaacctaacccgttacgttacgtttacgacccggtaggaacctacggtacgtagacacgtacgtactaacggtacgtcgtacgtcgtaccgactagtctcgttcgttacc

SEQ ID NO: 170084 - DNA, 820 bp, Homo sapiens
  misc_feature: GYAE6OF01C4YFZ.14.30.C08.1.454.CMB.1.raw
  modified_base (211)..(211): a, c, t, g, unknown or other
  misc_feature (211)..(211): n is a, c, g, or t
  modified_base (814)..(814): a, c, t, g, unknown or other
  misc_feature (814)..(814): n is a, c, g, or t
tcagcgtctagtaccacgaccggtgctcgatttagtctgacgtcaaagggaaagggggcaggagtcagtctcagtcaggacacagcgtggacatgagggtcccccgctcagctccgtggggcttccttctactctggctccgaggtgccagatgtgacatccagatcgacccagtcctccactccctccctgtctgctatcgtggtggganacaagaactccgagcctataccgtacgttcgggcccgggacgaacgtaccgacgggacctaattacgtaaccctttaaacccgtttttaaagtttggtaactacgaagtacaacggaacgaccggaacgggtaaacctacccccgtttaaacttaccgtacgtaacttcgttaagtagaactaccgaacctaaaacctttaaagtttaacgaaaggtacggttaccggtaaccttacccgtaattaccggttaaggttaccgtagggttacggggtacgggtacggtaacggttccgggtacgggggtacgtttaccgtttaccgtaccttacccgtaccgtaaccgacttaccgacgtacgttacgtaccgtaccgtaacctaacgttagtaacgtttaccgtttagtacccgttaacgttccggtaggttaccgtaaccgttaaacgggttagtttaacctaacgtaacccgtttaccccgttaacgtttaccgggttacccgtaccgggtaaccgggtaacctaaggtccgtaaggaaccttagtaaccgacgtaagtaccgtggtacggtacctaccggtacacctttcgtcccggttntacccg

SEQ ID NO: 170085 - DNA, 734 bp, Homo sapiens
  misc_feature: GYAE6OF01D2O0O.14.30.C08.1.454.CMB.1.raw
  modified_base (106)..(106): a, c, t, g, unknown or other
  misc_feature (106)..(106): n is a, c, g, or t
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (312)..(312): a, c, t, g, unknown or other
  misc_feature (312)..(312): n is a, c, g, or t
tcagcgtctagtaccacgaccggtgctcgatttagtctgacgtcaaagggaaagggggcaggagtcagtctcagtcaggacacagcgtggacatgagggtccccgntcagctcctgggctccttctactctggctccgaggtgccagatgtgacatccagatgacccagtctccatccctcctgtctgctatctggtggganacagaatcagcatcactggccgganaagtcagctattcgacttacctttaatgtatcagacagaacgacgaaggaaccgtaccccttaaacttctagattactatagacncgaactaacctaatttaacaagtatacggaactccctaagtacgtacggttacgaggtcggtacggtagtacgttacggtcggggtacgttactttacgtaccgttacctaaccgtacctacgttacgacgtaccgtacggttacgttacgtaacctaaaccgttaggtaacgtttacgttttacggaacccgtttaactttacggtacggttaccgttaacgtaaacggttacggtttaaccttaacggtaaacccgtttaacccgttaacgtttaaccgttttaaccggggaaccggttaacggggtaaccctaacggttacgtaccgggtaacctaacggtaacgtaaaccgtaacggttaaaccggttcgtagggtacccttacggtaacccaacgtttacctccgtttccgttaccc

SEQ ID NO: 170086 - DNA, 890 bp, Homo sapiens
  misc_feature: GYAE6OF01BJ6ZD.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgcctagatgtgacatccagatcgacccagtcctccatccctccctgtctgctatctggtgggacgtacagtaactcagctatcctacgttacggccgggactaagtcgacggccttaacgttagtaacccttaaccctttttaaagttcgggttaactcgaacgacgaaggaaccggtaccggaacggggtaaacccgtaccccttaaacttcgtagacttactaagttagaacgttccgaactaaaacccttaatttaaacgtaacggtagtaacgggtaccgtaacccgtagttaaaaccgtacgggttaaccggtaggttggggtaccgggtaggtaacgggtttcggggtacggggttaccggttaccgtttacgtaacccgttaaccgtaccgtaaccctacgtaaccggtaccgacgttaccggttacgttaaccggtaacccgtaagttacggttaaactttacggtttacggtaaccgttttaccgtttacgggttagggtaacccgttaccgttaaacgggtttacggtttaacccgaccgttaaaaccccgtttaccccgggttaaaccgttttccggttaaaccggggtacccggaacggggtaacccgtaaacggttcccgggttaaagtacccgttaaacgttaacggaaacccggttacgggttaaacggttaccggtccggtaaccgttaaccgtccggttaaaacccgttcgttcgttcccgtttaacccg

SEQ ID NO: 170087 - DNA, 734 bp, Homo sapiens
  misc_feature: GYAE6OF01CYVL0.14.30.C08.1.454.CMB.1.raw
  modified_base (214)..(214): a, c, t, g, unknown or other
  misc_feature (214)..(214): n is a, c, g, or t
tcagcgtctagtaccacgaccggtgctcgatttagtctgacgtcaaaggggaaagggggcaggagtcagtctcagtcaggacacagcgtggacatgacgggtccccgctcagctccgtggggctccttctactctggctccgaggtcgcagatgtgacactccagactcgaccagtcctcctactccctcctgtctgactactcgtggaggganacaagaatcagcatcacgttcggccggactacgtcgacgctatacgtaaccttaaccgttttaaagttcgtaactacgacgaacgaacggaaacgaccggtaaacgggaaacccgtaacccctttaaacgtttacctagtacttacgttaagtacgtactacgtaaacctaaaccttaaagtttaaccgaagttacggtacggtaaccctacgtaacttaacggaacggttacgtagggtcgggtacggttaggtaccgttcggggtacgggtacttactttaccgtacttaccgtactacctgtacgagtacgtacgtacacgtaacctacgttaagttaaccgttgtttcggaacttacgtaggtcggttataccgaaggtttacgtactaaccgttaaccttaccggtacgtccggttacgaacggtacgggtaacaggttacgcgtaaccgactaacgtacgtaaggtacgtacggtaacgtcggtactaccgttctaacgttccgttagttaccc

SEQ ID NO: 170088 - DNA, 859 bp, Homo sapiens
  misc_feature: GYAE6OF01EF1E7.14.30.C08.1.454.CMB.1.raw
  modified_base (194)..(194): a, c, t, g, unknown or other
  misc_feature (194)..(194): n is a, c, g, or t
tcagcgtctagtaccacgaccggtgctcgatttagtctgacgtcaaagggaaagggggcaggagtcagtctcagtcaggacacagcgtggacatgagggtccccgctcagctccgtggggctccttctactctggctccgaggtgccagatgtgacatccagatcgaccctagtcctccactccctcctgtctnctactcgtggtagggaacgactaagaactcgagactatacctacgtcgaccggactaacggtcgacggcctagtacgtaaccttaaccgttttaagtgtacacgagtacaagaacggacgaaacggaaccgtaccccttaatcgtatacttacgtatgaactaccgtaactaaaaccttaagtaaacgaaggtacgttacggtaacctaccgtaacgtaacgtaacggttacggtaaggtcggggtacggtacgggtacggtacgggtacgggggttaaccttacgtttaccgtaacccgttaccgtacccgtaaccgtaacgtacgacgttaccggtacgttaccgtaacccgtaaccgtaaaccggttaagggttaaacgtttaccggtttacgttaacgttaaccgtttacggttaccgggttaagttaaacccgttaaagggtttaaccgttaaccgttaaccgtttaaaccccgtttaacccggtttaaccggttttaacccgggttaccgggtaacccggaaacggggtaacccgtaaacggtccggtaaaccggtaacctaaccggttaaccggtaacccggttaaacggttaccgggttaacgtccgggtaactttacccgaaccttaccgttacgttcccgtttaccggttaaccc

SEQ ID NO: 170089 - DNA, 855 bp, Homo sapiens
  misc_feature: GYAE6OF01E3P9V.14.30.C08.1.454.CMB.1.raw
  modified_base (206)..(206): a, c, t, g, unknown or other
  misc_feature (206)..(206): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccactcctccctgtctgctactcgtggtggganacagatcagctatctacgttcggccgggtacaagtcgacggcctattacgaaccttaacccgtttttaaagtcggttaactcagacaaggaacgaccgaacgggaacctacccccttaaacttcgtagacttacgtagtcgtaactacgaaccctaaaccttaagtttaacgaaaggtagtacggtaaccttacccgtaagttaccggtaaacggtttaccgaggggttaccgggtacgggttaacgggttacgttaccggggggttacgggggttaaccgtttaaccgtttttccgaacccgtttacccgtaacccgtaaccgtacgttaacccgacggttacccgtaacggtttcccgtaaccggttaaaccccggtaacggtttaagggttaaacccgtttagttttacccggaaccgtttaaccgttttacggttacgggttaaacgttaacccggtaaacgggtaacggttttaccctaaaccgttaacccggtttaacccggttaacgttttaccgggtttacccgggaccggaacccggggttaacctacgtaccggttacgaaccttacgtaaccgttagttaacccgtggttcgggaccttagacccgtacctaaccttgtttacccgtgtttaaccccg

SEQ ID NO: 170090 - DNA, 1009 bp, Homo sapiens
  misc_feature: GYAE6OF01B5CR9.14.30.C08.1.454.CMB.1.raw
  modified_base (208)..(208): a, c, t, g, unknown or other
  misc_feature (208)..(208): n is a, c, g, or t
tcagcgtctagtaccacgaccggtgctcgatttagtctgacgtcaaagggaaaggggggcaggagtcagtctcagtcaggacacagcgtggacatgagggtccccgctcagctcctggggctccttctactctggctccgaggtgccagatgtgacatccagatcgacccagtctccatccctccctgtctgctatcgtggtaggganacaagaatcgagacatcctacgttcggcccgggtataacgtcgacggcctagttaccgaaccttaacccgtttttaaaagtttgggttaacttacgaacggtaccgtaaacggaaaccgggaaccggtaaaaccgggggtaaaaccccgtaaccccccgttttaaaaaccgtttccgttaacggtaaccttaccgtttaaagttacggtaacttacggaaccccttaaaaacccgttaaaattttaaaaccggaaacggtaacggttaacgggtaacctttacccccgaaagtttaacccggttaaaggtttaccgggtagggtacggggttacggggtacggtaccggttaccggggtccggggggtaacgtttacttaccggtaacccgttaccgtaccccgttaaccgtacgttacccggaacgtaaccggtaccggtttacccgtaacggtaaacccttaaccgggttaaagttaaccggttttaacgttttaccggtaacccggttttaaccggttttaacgggtaccggttaacggtaacccgtttaacgggttaaccggtttacctaaacccgtttaacccggtttaaaaccccgggttaccgtttttaacgggtttaacccggggaacccggggtaacgggtaaaccccgtacggggttaacccggttaccggaaacccggtttaacgtaacccgtaacgggttaaccccggttaaggttccggggtacggttacccggttacgaacccccggttaagtttaacccgttcccgggtttacgtttaacccccgg

SEQ ID NO: 170091 - DNA, 847 bp, Homo sapiens
  misc_feature: GYAE6OF01A8XEC.14.30.C08.1.454.CMB.1.raw
tcagcgtctagtaccacgaccggtgctcgatttagtctgacgtcaaaggggaaagggggcaggagtcagtctcagtcaggacacagcgtggacatgagggtccccgctcagctcctggggctccttctactctggctccgaggtgccagatgtgacatccagatcgacccagtctccatccctccctgtctgcatcgtggtgggagacagaatcgagctaatctacgttcgggacccgggacaagtccggacgcctaattcgaaccctttaacccgtttttaaagtttgggttaactacgaacgtcgaaacgaacggacccggaaaaggggtaaaccccgtaacccccttaaactttcgtagtacttactagtgtaactaccggaacctaaacttaaatttaacgaaggtagttacgggtaaccctacccgtaacgttaaccggtaaacggggtttccgaagggggttcgggtacgggggtttaacgggtaacgggtttccgggggttaacggggggtccgtttaaacgttttcccggtaccttacccctttaccgaacccgtacgtaccgtacgtaccggttacgtaccgttacgaaccgttaacgtaacggttaagtttacgttttacggaacccgtttaaccgtttacggttacggttaccgttaacggtaacggttaacggttacttaaccgtaacccgttaccgttaacgttaccgtttaccgggtaaccgggtacggtaaccgacgtaccggtagtaaaccgtacgttacgtaacgttaacggtaccggttcggtacggacccgtccggtaactaccgttacgttaccgtccctttacccg

SEQ ID NO: 170092 - DNA, 679 bp, Homo sapiens
  misc_feature: GYAE6OF01DJ13L.14.30.C08.1.454.CMB.1.raw
  modified_base (108)..(108): a, c, t, g, unknown or other
  misc_feature (108)..(108): n is a, c, g, or t
  modified_base (170)..(170): a, c, t, g, unknown or other
  misc_feature (170)..(170): n is a, c, g, or t
  modified_base (179)..(179): a, c, t, g, unknown or other
  misc_feature (179)..(179): n is a, c, g, or t
  modified_base (519)..(519): a, c, t, g, unknown or other
  misc_feature (519)..(519): n is a, c, g, or t
  modified_base (646)..(646): a, c, t, g, unknown or other
  misc_feature (646)..(646): n is a, c, g, or t
  modified_base (656)..(656): a, c, t, g, unknown or other
  misc_feature (656)..(656): n is a, c, g, or t
  modified_base (662)..(662): a, c, t, g, unknown or other
  misc_feature (662)..(662): n is a, c, g, or t
  modified_base (675)..(675): a, c, t, g, unknown or other
  misc_feature (675)..(675): n is a, c, g, or t
tcagcgtctagtaccacgaccggtgctcgatttagtctgacgtcaaaagggaaagggggcaggagtcagtctcagtcaggacacagcgtggacatgacgggtccccgntcagcctccgtcgggccttccttctactctggctccggaggtgccaagatgtgacatccagntacgacccngtctcctactccctccctgtctgctatcgtggtgggaactacgaacgaatcgagctactccacgttcggcccggaactaacgtcgacggtacctagtacgtaaccttaaccgttttaaagtcggtactacgagacgtagaacggaccgaaagggtaacccctacccttaaactttcgtacgtacttcgtaatacgactacgtaacctaaaaccgtaactttaaacgacgttaagaccggtaacctaacccgtagtttaaccgtaaggtttcgacggggttacgggtcggttagtacgggttcgggtcgggttacgtccgttactactcctacgtacactnaccgtacgttagcgactaccgtataagtacgtttagttcgacttacgtcgttggttacaacgtacgtagttccacgttaacgtaccgttcgtacgttcgtacgacggactagcctagacacgtaacngtacgtgtcngtcctntacatctccgttnaccg

SEQ ID NO: 170093 - DNA, 678 bp, Homo sapiens
  misc_feature: GYAE6OF01AMPSP.14.30.C08.1.454.CMB.1.raw
  modified_base (107)..(107): a, c, t, g, unknown or other
  misc_feature (107)..(107): n is a, c, g, or t
  modified_base (149)..(149): a, c, t, g, unknown or other
  misc_feature (149)..(149): n is a, c, g, or t
  modified_base (159)..(159): a, c, t, g, unknown or other
  misc_feature (159)..(159): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
tcagcgtctagtaccacgaccggtgctcgatttagtctgacgtcaaagggaaagggggcaggagtcagtctcagtcaggacacagcgtggacatgagggtcccccgntcagcctccgtgggtccttccttctactctggctcggaggtnccagtatgtnacatccgagatcgacccagttccctcctactccctccctgttctgctagtcgtggaggganactagaactcganctatccgtacgtcgggaccggtactaagcgacgtacctagtcgtaaccttaaccttttaagttacgtancgacacgaggaaccgaccggtaacggtaaccctaccttaactagtacgtattcctagtagtactacaacctaaactaagttacgaagttacgcggtacaccgttacgtagtacgtaggaggtcggtggtagtcggtggtacgggttctacttctaccgtacctcacgtcgtacgacgtactaccgtctacgaacgttaaccgttaggttaactttacgggtattaccggtttagttaggtacggttacgttacgtaacgttgtaaccttactaaccgttaccgttacgttacgtacggtaccgacggaaccgtagacgtactatacgtacttaccgtatccgttagtaccctgtacctactagtccttcgtcttcg

SEQ ID NO: 170094 - DNA, 519 bp, Homo sapiens
  misc_feature: GYAE6OF02HWVVS.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccaatttacaagatggatcccatcaaggttcagtggcggtggatcgtggggcgtatttcactctcaccatcagcagtctgcaacctgaagtatttgcgtacttactggtgtacaacgtaggttatactaactaacccgtactacgttttcggacctagggaccaagctagactagtacactacgaacttgtggctcgccaccattcctgttcc

SEQ ID NO: 170095 - DNA, 503 bp, Homo sapiens
  misc_feature: GYAE6OF02GBCQK.14.30.C08.1.454.CMB.1.raw
  modified_base (497)..(497): a, c, t, g, unknown or other
  misc_feature (497)..(497): n is a, c, g, or t
tcagcgtctagtaccacgaccggtgctcgatttagtctgacgtcaaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaatggtatcagcagaagccagggaaagcccctaaaacttctgatctatgatgcaaccaatttacaagatgggatccatcaaggttcagtggcggtggatcgtggggcgatttcactctcaccatcagcagtctgcaacctgaagtatttgcgtactttacgtggtgtcaacgtagggttatctactaacccgtactacttttgaccagggaccaagctaggacatcatacgaactgtgctgcacntctgtc

SEQ ID NO: 170096 - DNA, 531 bp, Homo sapiens
  misc_feature: GYAE6OF02G1D29.14.30.C08.1.454.CMB.1.raw
  modified_base (361)..(361): a, c, t, g, unknown or other
  misc_feature (361)..(361): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaatctgatctatgatgacaaccaatttacaagatggatccatcaagttcagtgcgtgatcgtgggcgattcactcncaccatcagcagtctgacaacctgaagtatttgcgtacttactggtagtacaacgtagggttatactaacgtaacccgtactacgttttcggaccgtaacgggaaccctaagcctagggactacgtacaattaacgaacttggtggtactcgaccacctatcgtgttccg

SEQ ID NO: 170097 - DNA, 682 bp, Homo sapiens
  misc_feature: GYAE6OF02FE37S.14.30.C08.1.454.CMB.1.raw
  modified_base (208)..(208): a, c, t, g, unknown or other
  misc_feature (208)..(208): n is a, c, g, or t
  modified_base (665)..(665): a, c, t, g, unknown or other
  misc_feature (665)..(665): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggcttccttctactctggctccgaggtgccagatgtgacatccagatcgacccagtactccactccctcctgtctgctatcgtggtagganacagaactcagcactcacgtcgccggacaagtcgacgtctagttacgtaaccttaaccgtttaaagtcggtaacacgaacgacgaacgaaccggaacccggtaaacgggtaaaccccttaccccttaaaacgtttcgtaacgtacttacgttaagtacgaactacgtaaacctaaaccttaagttaacgaagtcgtacgactaccgtaagtacggtaagtcgaggtcgggtacggtagtacggtcggtacgggtacttactccgacttaccacgactagtcgacgtctacgtaccgtacgaactacgttagtaacgttcgttacgtacgttacgttacgtcgtacgtaacgtacgttacgttacaccgttaaccgtaccgttacgtacggttacgacgtaacggactacgtagtacgatacgtactacgtacgtacgtcgtacgtactacgtacctntaccgttcttacgtacc

SEQ ID NO: 170098 - DNA, 548 bp, Homo sapiens
  misc_feature: GYAE6OF02HLN8U.14.30.C08.1.454.CMB.1.raw
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctgctccgaggtgccagatgtgacatccagatgacccagtctccatcctccctgtctgcatctgtgggagacagaatcagcatcacttgccgggnaagtcaggccattgactacctttaaatgtatcagcagaagccagggaancccctaaattctgatctatgatgcaaccaatttacaagatggatccatcaaggttcagtgcggtgatcgtgggcgtatttcactctcacatcagcagtctgcaacctgaagtattttgacgtacttacgttggtgtacaacgtagggttaactacgtaactaacccgttaactacgtttttacggacccgtaaggggaaccctaagtccgtaggaacctagtaccaattaacgaacttggtaggtctacggacctaaccgtacttcttgttacc

SEQ ID NO: 170099 - DNA, 594 bp, Homo sapiens
  misc_feature: GYAE6OF02I7DG6.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaacgcccctaaaacttctgatctatgatgacaaccaatttacaagatgggatcccatcaagttcagtggcggtggatcgtggggcgtatttcactctcaccatcagcagtctgcaacctgaagtattttagcgtactttacgtggtacgtacaacgtagggtttataccgtacttaaacccgttactaccgtttttacgggacccgtaacggggtaaccctaagggtccttagggaacctaacgttacctaacgttaaccggtaaccgttaggttacgggtacttacggacctaacccgtatttcccgttgtttaccc

SEQ ID NO: 170100 - DNA, 591 bp, Homo sapiens
  misc_feature: GYAE6OF02HXXZ2.14.30.C08.1.454.CMB.1.raw
  modified_base (429)..(429): a, c, t, g, unknown or other
  misc_feature (429)..(429): n is a, c, g, or t
tcagcgtctagtaccacgaccggtgctcgatttagtctgacgtcaaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttggccggcaagtcaggccattgacacccttttaaattggtatcagcagaagccagggaaagacccctaaacttctgatctatgatgacaaccaattttacaagtatagggatcccatacaaggttcaggtggcggtggatcgtggggcgtatttcactctcaccatcagctagtctgacaacctgaagtatttagcgtacttacgtggtntacaacgtagggttactacgtaacgtaacccgttacgtaccgtttttcgggaccgaacggggtaacccgtaagtcgtacgggtacctacgttaccgaacgttaacgaacgtttaggtcggtacgttcggacccgtaacccgtagttaccgttcgtttacccg

SEQ ID NO: 170101 - DNA, 661 bp, Homo sapiens
  misc_feature: GYAE6OF02J2UXX.14.30.C08.1.454.CMB.1.raw
  modified_base (422)..(422): a, c, t, g, unknown or other
  misc_feature (422)..(422): n is a, c, g, or t
  modified_base (595)..(595): a, c, t, g, unknown or other
  misc_feature (595)..(595): n is a, c, g, or t
  modified_base (601)..(601): a, c, t, g, unknown or other
  misc_feature (601)..(601): n is a, c, g, or t
  modified_base (654)..(654): a, c, t, g, unknown or other
  misc_feature (654)..(654): n is a, c, g, or t
tcagcgtctagtaccacgaccggtgctcgatttagtctgacgtcaaagggaaaggggcaggagtcagtctcagtcaggacacagcgtggacatgacgggtccccgctcagctccgtgggcctccttctactctggctccgaggtgccagatgtgacatccagactcgacccagtcctccactccctcctgtctgctagtcgtggaggacacagactcacgctactccgtacgtcggaccgtactaacgtcgaccgtacctaacgttacgtaaccctttaacgtttaagcggtacacgacgaaccgaaggtaccgaaccggtaaaccgtaccctaccttaacgtcgagtacttactacgagtaacctaacgtaacctaagttacgtaacgagtacgtacgtacctacgtagtcggtagtcggnggtcgggtacgtactacggtcggtacggtacttactaccctactacgtaccaagttcgacgtacgtcctacgtactaaccggtaactacgttaacgtacgttacgttactacgttacgttagtaccgtaatacgtacgtacttactacgtaccgtagtcgtacggacgacganctacgnacacctgaacgtacgtaccgtagtccgactcgacttaccgtcttccgttcgtnttacccg

SEQ ID NO: 170102 - DNA, 552 bp, Homo sapiens
  misc_feature: GYAE6OF02FMYNF.14.30.C08.1.454.CMB.1.raw
  modified_base (226)..(226): a, c, t, g, unknown or other
  misc_feature (226)..(226): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggnaagtcaggccattgacacccttttaaattggtatcagcagaagccagggaaagcccctaaacttctagatctatgatgcaaccaatttacaagatgggatccatcaaggttcagtggcggtggatcgtggggcgatttcacgtctacaccatcagcagtctgcaacctgaagtattttgacgtactttacgtggttgtacaacgtaggttataccgtaactaacccgttactacgtttttcggaccgtaacggggtaccaagccgtaggaccagttaccaagttaacgtaactagtaggtcgtcgacctaccgattcgtgttaccc

SEQ ID NO: 170103 - DNA, 613 bp, Homo sapiens
  misc_feature: GYAE6OF02IGQGM.14.30.C08.1.454.CMB.1.raw
  modified_base (279)..(279): a, c, t, g, unknown or other
  misc_feature (279)..(279): n is a, c, g, or t
  modified_base (414)..(414): a, c, t, g, unknown or other
  misc_feature (414)..(414): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattcgacaccctttaaatcggtatcagcagagccaagggaacncccctaaattctagatctagtgatagacaacctaattacaagatgggactccatacgagttcagtagggcgtaggatagtggggtacgtatttcacgtctcacctagtacagcagtctcgacaacctagtaagtntttcgacgtacttacgtacggttgtaccgaacgtagggtttactaccgtaaacttaacccgttacgtaacgttttcggaacccggtaacggggaaccaacgttcgtacgggtaacctacggtaactaacgttaaaccgtaacgttagggttaccgggaccttacgggaccctaacccgtagtttacccgttgttaaccc

SEQ ID NO: 170104 - DNA, 588 bp, Homo sapiens
  misc_feature: GYAE6OF02HBFGX.14.30.C08.1.454.CMB.1.raw
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgactacccttttaaattggtatcagcagaagccagggaaacncccctaaattctagatctatgatgacaacctaatttacaagtatggatcccatacaaggttcagtggcggtggatcgtggggcgtatttcactctacaccatacaacngtctcgacaacctgaagtattttgcgttactttactggtctacgaacgtagggttactacgtaaccttaacccgtactacgttttacggaccgtaacggggaacccaagtccgtagggaccagttaccaaacgttaaccgtaaacgttggttacggaccttacgaccctacccgtacttccgttcgttaccctttaccg

SEQ ID NO: 170105 - DNA, 520 bp, Homo sapiens
  misc_feature: GYAE6OF02GUB9X.14.30.C08.1.454.CMB.1.raw
  modified_base (418)..(418): a, c, t, g, unknown or other
  misc_feature (418)..(418): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacctttaaatggtatcagcagaagccagggaaagcccctaaacttctgatctaatgatgacaaccaatttacaagatggatccatcaagttcagtggcggtggatcgtggggcgtatttcactctcaccatcagcagtctgcaacctagaagtattttgacgtacttacgtgggtntacaacgtagggttatactaacttaacccgtatacgttttcggacctaggggtaccaaggctaggactatacaatacgaactgtaggctgccacatctgtcc

SEQ ID NO: 170106 - DNA, 574 bp, Homo sapiens
  misc_feature: GYAE6OF02H32SO.14.30.C08.1.454.CMB.1.raw
  modified_base (480)..(480): a, c, t, g, unknown or other
  misc_feature (480)..(480): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgactaccttttaaatggtatcagcagaagccagggaaacgcccctaaaatctagatctatgatgactaaacctaaatttacaagtatagggactaccccaattacgaaaggtttcaaggtggacggtggacgtcgtgggggcgtatttcgactctacaccatcagcagtctagcaacctgaatagttttgcgtactttacgtgttgtacaaacgtagggttacttacaacttaaacccgtntaaccgttttggaccgtaagggacctaagctacggaactagtcaacgtaacgaacttggtagacttcggacctaaccgtacttccgttgttacc

SEQ ID NO: 170107 - DNA, 639 bp, Homo sapiens
  misc_feature: GYAE6OF02J1B96.14.30.C08.1.454.CMB.1.raw
  modified_base (155)..(155): a, c, t, g, unknown or other
  misc_feature (155)..(155): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagcgtctagtaccacgaccggtgctcgatttagtctgacgtcaaagggaaaggggcaggagtcaggtctcagtcaggacacagcgtggacatgacgggtccccgctcacgctcctggggcctccttctacctctcggctccgaggtcgccagntgtgacactccagatgacccagtctccatccctcccgtgtctcgactacttctggtcgggagaccagaactcagcatcacttgccgggcaagtcaggccattcgacctacctttaaatgtatcagcagaacgcgagggaacnccctaaattcagactctancgactcgaccaactaatttaacaagtcgtggactccagtacgtaacggttacagggttcggacggttaggacttcgggtacggggtacgtattttccgtacgccgttaccgactagtaccgaagtcgtacgtcgtacgtaaccaaccgttaggtaacgttactttcggaccgttacttacggtcgttagtaccgtaaacgtgggtttactacgtaaccgttaaccgttacgtacggtttcgggaccgagggaaccagtcgtacgactacgtccaacgtacgaacgtcgtaggcccttaggacccctataccgttcttcccgtc

SEQ ID NO: 170108 - DNA, 597 bp, Homo sapiens
  misc_feature: GYAE6OF02FW43Y.14.30.C08.1.454.CMB.1.raw
  modified_base (416)..(416): a, c, t, g, unknown or other
  misc_feature (416)..(416): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaaacttctgatctatgatgacaaccaatttacaagatggatccatcaagttcagtgcggtgatcgtggggcgatttcactctcacatcagcagtctgacaacctgaagtatttgacgtacttacgtggttntacgaacgtagggtttaactactaacgtaacccgttaactaccgtttttacggacccgtaacggggaacctaacggaccgttagggaacctacgttaccgaaacgttaaccggtaaaccgtttacggttacgggtaccgttcggtacccgaacccgtaacgtttccgtacgttttaccccg

SEQ ID NO: 170109 - DNA, 642 bp, Homo sapiens
  misc_feature: GYAE6OF02GVSBW.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctggtgggagacagaatcagcatcacttgccgggcaagtcaggccattcgactaccttttaatggtatcagcagaacgccaagggaaacgcccctaaattctagattctatgatcgactaacctaatttacaagagtgggactcccatacaagggttcaaggtcggacgggttaggacttcggtagggggtacgtattttacgacgttcctaccaacctataccgagctagtctacgacctaacgtaggaacgttacttttggaccgttaacgtttacgtcgggttacgttactaaaccggttaggggtttaactaccgtaaacgttaaaccccgttacttaaccgtttttcgggaacccgtaacggggaacctaaggcgttacggaactacgtacaacgttaaccggaacttcggtacgtcgtcgtacccacctatttccgtattaccc

SEQ ID NO: 170110 - DNA, 575 bp, Homo sapiens
  misc_feature: GYAE6OF02IRDVJ.14.30.C08.1.454.CMB.1.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggcaagtcaggccattgactacccttttaaattggtatcagcagaagccaagggaaacncccctaaaattctagatctatgatgcaaacctaatttaacaagtatagggatcccatacaaggttcagtggcggtggatcgtggggcgtatttcactctcaccatcagcagtctgacaacctgaaagtatttcgacgtactttactggttagtactaaacgtagggttaactactaacgtaaaccccgttactacgttttacggacccgtaaggggaaccaagtcgtaggaactacgtacataacggaacttaggtacggtcttacggacctaacccgtattccgttgttacc

SEQ ID NO: 170111 - DNA, 543 bp, Homo sapiens
  misc_feature: GYAE6OF02HCMTW.14.30.C08.1.454.CMB.1.raw
  modified_base (282)..(282): a, c, t, g, unknown or other
  misc_feature (282)..(282): n is a, c, g, or t
  modified_base (411)..(411): a, c, t, g, unknown or other
  misc_feature (411)..(411): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattcgactaccttttaaatggtatcagcagaagccgaagggaaacncccctaaacttctagatctatgatcgacaacctaatttacaagataggactcccatacgaagttcaggtggcggtagagtcgtggggcgtattcactctcaccatcagctagtctgacaactgaagttntttgcgtacttacgtggtacgtacaacgtaggttatacctaacgtaacccgtactaccgtttcgaccgtagggaaccagcgtacgactagtcaacgtacgacgtggtagctacgacaacctnttcgtnttcc

SEQ ID NO: 170112 - DNA, 559 bp, Homo sapiens
  misc_feature: GYAE6OF02G117G.14.30.C08.1.454.CMB.1.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggcaagtcaggccattgacagtccttttaaatggtatcagcagaagccgagggaaacncccctaaacttctagattctatgatgacaacctaatttacaagtatacggatcccatcaaggttcaggtggcgtggatcggtggggcgtatttcactctcaccatcagcgagtctgacaactagagtatttgacgtacttacgtggtcgtacaacgtagggttactactaacttaacccgtacttacgttttacggaccgtaacgggaccaacgcgtacggacgtactactaacgtaacgtaacgttaggtcggcgttcgaccgtacctagttcttcg

SEQ ID NO: 170113 - DNA, 621 bp, Homo sapiens
  misc_feature: GYAE6OF02GNKS9.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttcgccgggcaagtcaggccattgacctacccttttaaattggtatcagcagaagccgaagggaaacgacccctaaacttctagatctatgatgaccaaccgtaatttaacaagtatgggactcccgaatcaaggttcaggtcggaggtggagtcgtggggacgtatttcacgtctcacctatccacgacacgtctacgactaacctgtaaacgtagttttacggactactttacgttggtacgtactaaacgtacgggtttaactaccgtaacttaacccgttaacttacgttttacgggaccgtaacgggtaacctaagtccgtaggactaagtccgtaacgttaaccgaacttcggttacggtcgtacggaccctaacctacgtttaccgtcgtttacccg

SEQ ID NO: 170114 - DNA, 559 bp, Homo sapiens
  misc_feature: GYAE6OF02HW9PW.14.30.C08.1.454.CMB.1.raw
  modified_base (279)..(279): a, c, t, g, unknown or other
  misc_feature (279)..(279): n is a, c, g, or t
  modified_base (444)..(444): a, c, t, g, unknown or other
  misc_feature (444)..(444): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctcctgtctgcatctgtgggagacagaatcagcatcacttgccgggcaagtcaggccattgactaccttttaatggtatcagcagaagccgaagggaaacncccctaaacttctgactctaatgatcgactaaacctaatttacaagtagtggactccgatcgaaggttcaggtggcggtgacgtcggtggggcgtatttcactcgtcacatcagtctagtcagtacaactagaagttagtttcgacgttacttacgtgtacgtanaacgtaggttacacgtaacgtaacccgttacttacgtttcgaccggtaagggaccctaaggctaggactagtcaagtacgactggtcgtactcggacctacgtactcgtgttacc

SEQ ID NO: 170115 - DNA, 553 bp, Homo sapiens
  misc_feature: GYAE6OF02FSHLO.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaacgcccctaaacttctgatctatgatgcaacaatttacaagatgggatccatcaaggttcagtggcggtggatcgtggggcgtatttcactctcacctatcagcagtctgccaacgtgaagtattttggccgtaacttacgtggtctacgaacgtagggttactacaacgttaaacccgttactaccgttttcgggccgtaacgggaccaagtccgtacggactagtcaataccgtaacgtcgtaggcttcggacctacctagttctagtttaccg

SEQ ID NO: 170116 - DNA, 709 bp, Homo sapiens
  misc_feature: GYAE6OF02HSHUA.14.30.C08.1.454.CMB.1.raw
  modified_base (106)..(106): a, c, t, g, unknown or other
  misc_feature (106)..(106): n is a, c, g, or t
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
tcagcgtctagtaccacgaccggtgctcgatttagtctgacgtcaaagggaaagggggcaggagtcagtctcagtcaggacacagcgtggacatgagggtccccgntcagctcctggggctccttctactctggctccgaggtgccagatgtgacatccagatgacccagtctccatcctcctgtctgcatctggtggagacagaatcagcatcacttgccgggnaagtcaggccattgactaccttttaatgtatcagnagagacgagggaacnccctaaattcagatcgtatgatgacaactaattacgaagtagtagggactaccctaagttacgaacggttcagggttcgggacgggttaggtacgttcggtagggggacgttatttccaccgttaccgtaccaacctacgttcaacggtcctacggttcccgtacgtaacctaaacccgttaggtaaacgtttagttttaccgggaaccgtttaacgtttaccggttacgggttacttaaccggtaaacggtttacggggttttactaaccgttaaacccgttaaacccgttacgtttaccgtttttacgggtaccggaaacggggtacctaacggttccgtacgggtaacctaaggttcgtaaaccggttaacggaacggttacggtagggttaccctcggtaccctaattaccgttacggttacctttaccg

SEQ ID NO: 170117 - DNA, 644 bp, Homo sapiens
  misc_feature: GYAE6OF02HG1PL.14.30.C08.1.454.CMB.1.raw
tcagcgtctagtaccacgaccggtgctcgatttagtctgacgtcaaaagggaaaggggggcaggagtcagtctcagtcaggacacagcgtggacatgagggtccccgctcagctcctggggctccttctactctggctccgaggtgccagatgtgacatccagatgaccagtctccatcctccctgtctgcatctgtgggagacagaatcagcatcacttcggccgggacaagtcacggcctattcgacctaaccttttaaattggtatcagacaagaacgccgaagggaaaccgtacccctaaacttctagactactatgatcgactaactaattaacaagtagtagggtactacctatacgtaaggttcgtaggtcggcggtaggagtcgggtacgggggtacgttacgttccgtacttccgtaccacctatcacgtactacgtcgtacaccgtaactaggtaacttagtttcgacgttacctttcgttaggtacgtactaacgtaggttactaaccgtacgtaacccgttacgttacgtttcgtacccggacggtaacgaacgtcgtacggtactacgtacgtaaccgtacggtaacgtcgtacgggcctcggaccctaccgtacttacgttcgtttaccc

SEQ ID NO: 170118 - DNA, 627 bp, Homo sapiens
  misc_feature: GYAE6OF02F20XH.14.30.C08.1.454.CMB.1.raw
  modified_base (201)..(201): a, c, t, g, unknown or other
  misc_feature (201)..(201): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggcaagtcacggcctattcgacctacccttttaaattggtatcagcagaagcaagggaaactacccctaaacttcgacgtatctatgatcgacaacctaatttacaagtagtagggactcccatacgaacggttcaggtggcggtaggcgttcggtgggggtcgtagtttccgattcctctacctactcagctagtactgaacctaccgtaggaactagttttcggaccgtaacgtttacgtggtacgtacaaggttaggttactacgtaccgttaaacccgttacgttacgttttacgggaccgtaacggggtaccaacggtacgtaggtacctaagtccgaaacgttacggtaacgttcggtacggtcgttacgacctaccgtattccgttacgtttacccg

SEQ ID NO: 170119 - DNA, 767 bp, Homo sapiens
  misc_feature: GYAE6OF02HAMWN.14.30.C08.1.454.CMB.1.raw
  modified_base (201)..(201): a, c, t, g, unknown or other
  misc_feature (201)..(201): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatccctcctgtctgtatctgtggganacagatcagcatcacgttgccggacaagtcaggccatcgactacctttaatgtatcagacagaacgaccgaagggaacctacccctaaattctagtatctatagatacgactaaactaagtttaacgaagtagtacgggtaacctacccgtaataccgtaaacggtttacgaacgggttcgggacgggttagggtacgttacgggtacggggggtaaccggttaacttttaccgtaccgttaccgttaacccaacccgtaacgtaccgtaacgtaccgtaacggttccgtacggtaaccctaaaccgttacggtaaagtttacgttttacgtaccggttaaccctttaacggttcggttaacgtaccgtaaacggttaagggttaccttacgttaaacccgttaacccgttaacgtttaaccggttttacgggaacccgggtaaacggggtaaccctaacggtaccgtaaggacctaacgtacgtaaacggtaaccgtaacggttacggtacggtaccgttaccgtacccgtaacgttaccttaccgttaccggttaccttacccg

SEQ ID NO: 170120 - DNA, 805 bp, Homo sapiens
  misc_feature: GYAE6OF02JLS16.14.30.C08.1.454.CMB.1.raw
  modified_base (230)..(230): a, c, t, g, unknown or other
  misc_feature (230)..(230): n is a, c, g, or t
tcagcgtctagtaccacgaccggtgctcgatttagtctgacgtcaaagggaaagggggacgagggaggtcagtctcagtcaggacacagcgtggacatgagggtcccgctcagctcctgggctccttctactctggctccgaggtgccagatgtgacatccagatcgacccagtctccactcctccctgtctgcatctgtggagacagaatcagcatcactcggccgganaagtcaggccattcgactaccttttaaatggtatacgagacagaacgccgtaacggggaaacgtacccccttaaaacgtttcgtaagtacttacgttacgtagtacgttacgaccgtaaaacctaaaagttttaaccgaaaggtacgtaggggtaacctcccctaattaaccgaaagggttttccaaacgggttgggaaccgggttgggtaactccgggttacgggggtacggttaaacttttccgaacccgttttacgacctaacccgtagttaccgaacggtccgttaagtcccgtacgtaaccaaacgttacggtaaagtacgtttttacgaaccgtttaccttaacggtttggtaccgttaacgtaaccggttaaggggtttaacttacccgtaaacgtttaaacccccggttaaacgtttaccgttttaggggaccccggtaaacgggggttaacctaacgggttacccgggtacggttaaacaccgttttaccggaaatttaacccggaacgttcgggttacggacctttaacgggcccttaaccggtaaccgttcgttaccgttaccc

SEQ ID NO: 170121 - DNA, 606 bp, Homo sapiens
  misc_feature: GYAE6OF02HGRT4.14.30.C08.1.454.CMB.1.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (405)..(405): a, c, t, g, unknown or other
  misc_feature (405)..(405): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggcaagtcaggccattgactacctttaaatggtatcagcagaagccaagggaacncccctaaatcagtatctatgatgaccaactaattacaagtataggactccatacgaaggttcaggtggcggtggagtcggtggggacgtattcactctcacatcagcagtctagacaacgtgaagtntttacgacgtacttacgtgtacgtacctaacggtagggtttaactacgtaacgttaaccccgttaacttaccgttttagggaaccggtaacgggtaacccgaaggtacgtacggtactaacgttaactaacgttaaaccggtaacgttagggtaccggtaccgttacggacccgtaacctacgttccgttaccggtttacc

SEQ ID NO: 170122 - DNA, 734 bp, Homo sapiens
  misc_feature: GYAE6OF02JUG24.14.30.C08.1.454.CMB.1.raw
  modified_base (202)..(202): a, c, t, g, unknown or other
  misc_feature (202)..(202): n is a, c, g, or t
tcagcgtctagtaccacgaccggtgctcgatttagtctgacgtcaaagggaaagggggacaggagtcagtctcagtcaggacacagcgtggacatgagggtccccgctcagctcctgggctccttctactctggctccgaggtgccagatgtgacatccagatgacccagtcctccatcctccctgtctgcatctgtggganacagaatcagctatccacgttcggccggacaaggtcaacgggcctattcgaacctaaccgtttttaaatcggtaacttcgaagtccgaagtacgaccaaacggggaaactacccctttaaagttctacggaacttacctaagtagtactacgtaacctaaaccttaaattttaacaaggtaacgtacggtaacctaccctacgttaacgtaaacgggtttcgaaggttcgggtacggtggacgttacggtcggggtacgttactttcgtaccttcgtaccgtaccaagttccgaggtcctacggtcctaggtaaccctaaacgttaaggtaacgtttcttttacgggacgtaaaccctttggtacgggttctaaccgtaaggtttacgggtttactaacctaacccgtttaaccgagttttaccggttgggaaccccggttaaagggaccctaagtcggtaagacctagttaaccggattaaaccgtggtcggtagtccgttcgaaccttcccgtatttcccggtattaccc

SEQ ID NO: 170123 - DNA, 539 bp, Homo sapiens
  misc_feature: GYAE6OF02F3D20.14.30.C08.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (284)..(284): a, c, t, g, unknown or other
  misc_feature (284)..(284): n is a, c, g, or t
  modified_base (417)..(417): a, c, t, g, unknown or other
  misc_feature (417)..(417): n is a, c, g, or t
  modified_base (452)..(452): a, c, t, g, unknown or other
  misc_feature (452)..(452): n is a, c, g, or t
  modified_base (501)..(501): a, c, t, g, unknown or other
  misc_feature (501)..(501): n is a, c, g, or t
  modified_base (532)..(532): a, c, t, g, unknown or other
  misc_feature (532)..(532): n is a, c, g, or t
tcagcgtctagtaccacgaccggtgctcgatttagtctgacgtcaaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggnaagtcacggccattcgacctacccttttaaatggtatcagcagaagccaagggaacncccctaaattctgatctatgatgaccaactaatttaacaagagtggactccatctaagttcagtggcggtgaatcggtaggggcgtactttacgacttcctacaccatcagcagtctgacctacgtataagtntttgactacttacgtggtctacgaagtaggttacnctaacctacccgttactacgtttcgggactacgggaaccagctaggacngttacatacgtacgttgacgctcgtccactntgcttcg

SEQ ID NO: 170124 - DNA, 855 bp, Homo sapiens
  misc_feature: GYAE6OF02HZIGN.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctccgtgggctccttctactctggctccgaggtgccagatgtgacatccaagatcgacccgagtcctccacttcccgtccctgtcgtcgactacttcgtggtagggacgaaccgaagtaacgtcacgtcattaccgaccgttcggcccggaacgtaaacgtccgaacggtacctaagttaccggtaacctttaaaccccgtttttaaagtttaggtaacttaccgaagaaccgtaaacggaaaccggtacccggtaaaacggggtaaaccccgtaaacccccttaaaaccgtttccgttaacgtaccttacttagtaccgagtaaccgacccttaaaaaccttaaactttaaaccgaaggttaacgtaacgggtaacccttaaccccgtaacgtttaaaccggaacggttttaacgacgggttacggtaccggggttaacggttacggttaccgggggttacggggtaccggtttaacttttacccgtacccgtttaacctcccgtaaaccgttacgttaccgacggtaccgtaacggttccctaacgaaaccgttaacgttacggtaagtttacgttaccgtacgttacgtttacggttagtacgtaacgtaacggttgtaactaaccgtaaccgttaaccgttacgttcggttaccgaacggtaccggaactaggccgtaacgtcgaacgtacgttacgtaaccgtgtcgtcgacgtccgactaacgttcgtaccttcgtacc

SEQ ID NO: 170125 - DNA, 667 bp, Homo sapiens
  misc_feature: GYAE6OF02IXSH3.14.30.C08.1.454.CMB.1.raw
tcagcgtctagtaccacgaccggtgctcgatttagtctgacgtcaaagggaaaggggcaggagtcagtctcagtcaggacacagcgtggacatgagggtccccgctcagctcctgggctccttctactctggctccgaggtgccagatgtgacatccagatgacccagtctccatcctcctgtctgcatctggtgggagacagaatcagcatctacgttcggccggtacaaagtcacggcctagttcgaacctacccttttaaagtggttactcagctaagaacggaccgagggaaacgtaccccttaaattcctagactctagtagactgaccaacttaagttaacaagtagtacggtactaccgtactacgtaaggttacctaggtcgggtacgggtttaggacgttacggtacggggggtacgtacgttttaccgacgtttaccgtactaccgtacgtaccgtacgcctaacggttaccgtacggtacctaacccgttaggtaacgttacgttttgaccgtttaacgttacgttcggtacgtactaacgtagggttactacgtactaccgttaactacgtttacgaccgtacggacgtaagcgtagactacgtcgacgtacgtaactggtacgccgttacgaccgtacctacttcgtagttacc

SEQ ID NO: 170126 - DNA, 600 bp, Homo sapiens
  misc_feature: GYAE6OF02FH4LX.14.30.C08.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagcgtctagtaccacgaccggtgctcgatttagtctgacgtcaaagggaagggggcagggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggcaagtcaggccatgacacctttaaattggtatcagcagaagccagggaacgaccctaaacttctgatctatgancgacaaacctatttaacaagtagtacgggtactacccgtaatacctaagggttccaaggtggtccgggtggtaacgtcggtgggggacggttattttccaccttctcaccacttcacgcagtcagtaccaacgtataagtatttacgtccgtacttacgtggtacgtacaacgtaggttactactacgtaaacccgtacttaacgtttacgaccgtaacggggaaccaacggctaggaccagttacaacgtaaccgtaacgttagtacggtcgtcgtaccctacctacgttcgtacgttcc

SEQ ID NO: 170127 - DNA, 726 bp, Homo sapiens
  misc_feature: GYAE6OF02GFF3K.14.30.C08.1.454.CMB.1.raw
  modified_base (192)..(192): a, c, t, g, unknown or other
  misc_feature (192)..(192): n is a, c, g, or t
tcagcgtctagtaccacgaccggtgctcgatttagtctgacgtcaaagggaaagggggcaggagtcagtctcagtcaggacacagcgtggacatgagggtccccgctcagctcctgggctccttctactctggctccgaggtgccagatgtgacatccagatgacccagtcctccatcctccctgtctgacnttctggtagggaacgacagaactcagcaactctacgttcggccggacaagtcgacggtcctagttcgtaacctaaccttttaaagttcggtactacgtagactaagacgacgaagggaacctaccctaaactcctagtactactagtagatacgacctaaactaatttaacaagtacgtacggtaactacccgtaagtaccgtaacgttcgagggttcggtacggtaggtacgttcggtacgggggtacgttacgttttccaacgttcctaccgtacctactacacgtacgtaccgtcgtaccgaaaccgtaacgtaagtaacggttgttttaaccggcctttaacgtttcggtaggtaacgttaccgtaacggtaacggtttaacaccgttaaccgttaacccgttaacgtttaccggttacggaccggtaacggtaaccgtaggtacgttaccgaactaccggttactaacgttaacgtaacggttacgtcggtacgtacccgtacctacgtactttccgttaccgttaccc

SEQ ID NO: 170128 - DNA, 612 bp, Homo sapiens
  misc_feature: GYAE6OF02FKY2N.14.30.C08.1.454.CMB.1.raw
  modified_base (296)..(296): a, c, t, g, unknown or other
  misc_feature (296)..(296): n is a, c, g, or t
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
  modified_base (588)..(588): a, c, t, g, unknown or other
  misc_feature (588)..(588): n is a, c, g, or t
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatccctccctgtctgcatctgtgggagacagaatcagcatccacttcggccgggacaagtcaggccagttcgacctacccttttaaattcggtattcgagcaggaacgccgaagggaaacncccctaaattctgactctagtgatgaccaaacctaatttaccaagtagtgggactcccatagaacgttnagtggcggtgagtcgtggggtcgtactttcacttccncactatcagtcacgtcgtcacctaaccgtagaagttactttacgacgttacttacgtcggttacgtactaacggtaagggttactacgtaaccttaacccgttacttaccgttttacgggacccgtaaggggaaccctaggacgttacgggactacgttaccgaattaacccggaagttgcggtcncgtaccgacctgtcgttacgttcc

SEQ ID NO: 170129 - DNA, 654 bp, Homo sapiens
  misc_feature: GYAE6OF02H0521.14.30.C08.1.454.CMB.1.raw
  modified_base (446)..(446): a, c, t, g, unknown or other
  misc_feature (446)..(446): n is a, c, g, or t
tcagcgtctagtaccacgaccggtgctcgatttagtctgacgtcaaaagggaaagggggcaggagtcagtctcagtcaggacacagcgtggacatgagggtccccgctcagctcctggggctccttctactctggctccgaggtgccagatgtgacatccagatgacccagtctccatccctccctgtctgcatctgtgggagacagaatcagcatcacgttcggccgggacaagtcgaggccattcgaacctacccttttaaatggtatcagcaagaagccgaagggaaactacccctaaaacttctagactcgtaatgatcgacctaaacctaatttacaagtagtggactccgatacgaaggttcaggtggcggtgagtcggtagggtcgtattcgactctcgaaccagtcgagcagtcgtacgactaacgtagtaaacgttnttttacggaccgttactttacgttgggttacgtaaccgtaacggttagggttaacttaacgtaacccgttaaaccgttaacttacggttttaccggaccggtaaacgggaccgtaaacggtccgtacggtacctagtacccgtaattaaccggtaacgttggtacggtcgtacggtaaccctaaccttacgtttccgtagtttacccg

SEQ ID NO: 170130 - DNA, 708 bp, Homo sapiens
  misc_feature: GYAE6OF02GLSAB.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctggtgggagacagaatcagcatacactcgccgggctaagtcgacggcctagttcgaacctaccttttaaattggtactcagacaagaacgtaccgaacgggaaacgtacccctaaacgttctaggtaacttcctatagtactcgaaccaacctaaatttaacaagtaagtacggggaccttaccgtaagttccgtaaacggttacgtaacggtcggggtacgggtagggtaacggttccgggtagggggtcggttactttaccgaccgtacctaccgacctacgtacgacgtctacggtccttagacctaaccgtaaggtaacgttactttacgacgttacgttacggttggttaacgtactaacgttaaggttctaaccgtaacgttaacccgttaagttaccgtttacggaaccggtaacgggaaccgtaacgtggtaccgaacgttactcgtaacgtaccgtaacgttcggtacgtaccgtcgaacctaccgttacgttctcgtttaacccg

SEQ ID NO: 170131 - DNA, 600 bp, Homo sapiens
  misc_feature: GYAE6OF02FI3EC.14.30.C08.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagcgtctagtaccacgaccggtgctcgatttagtctgacgtcaaagggaaagggggcagggagtcagtctcagtcaggacacagcgtggacatgagggtccccgctcagctcctggggctccttctactctggctccgaggtgccagatgtgacatccagatgacccagtctccatcctccctgtctgcatctgtggganacagaatcagcatcacttgccgggnaagtcaggccattgacacctttaaatggtatcagcagaagccagggaacgcccctaaagttctagatctatgatgcaaccaatttacaaagatgggactacccgatcgaaggttcaaggtggcggtggatcggtggggcgtattttcgacttctacgaccatcgacgcacgtctcgacaaccgtgaaacgtactttacggacgtactttacgtggttagtaccgtaaacgtagggttaactacgtaacgtaaacccgttaccttaacgtttttacgggaccgtaacggggaacctaaggccgtacggaacgacgttaccaataaccgaacgttacggtacggacctggacctacccgacttacgtgtttaccc

SEQ ID NO: 170132 - DNA, 656 bp, Homo sapiens
  misc_feature: GYAE6OF02JDJXI.14.30.C08.1.454.CMB.1.raw
  modified_base (637)..(637): a, c, t, g, unknown or other
  misc_feature (637)..(637): n is a, c, g, or t
tcagcgtctagtaccacgaccggtgctcgatttagtctgacgtcaaagggaaagggggcaggagtcagtctcagtcaggacacagcgtggacatgagggtccccgctcagctcctgggctccttctactctggctccgaggtgccagatgtgacatccagatgacccagtctccatcctccctgtctgcatcgtggtgggagacagaatcagcatcctacgttggccggcaacggtcaggccctagttcgacttaacccttttaaagtggtatctacgacaacgtaacgaccgtaacgggaaactaccccttaaaacttctacgaacttctaacgtctagtacgtaaccaaacccttaaagtttaaccgaaagtaagttcgggacttaccagtaccgtaagtcgagtcggaggtggagttcggtagggtcgtaagtttccgactaccgttcaacctataccgacacgtacgtcgacgacctaaccgtagaagtttagtttacgacgttacgttacgttggacttacgagtaggttacaccgttaaatacccgttacgtacgtttccggaacggccggtaacgacgtactcggaactacgtaacaacgtaacgtacgtcggttcgacgtccgtaaccncctaagtccttacgttacc

SEQ ID NO: 170133 - DNA, 744 bp, Homo sapiens
  misc_feature: GYAE6OF02JDQHU.14.30.C08.1.454.CMB.1.raw
  modified_base (205)..(205): a, c, t, g, unknown or other
  misc_feature (205)..(205): n is a, c, g, or t
  modified_base (630)..(630): a, c, t, g, unknown or other
  misc_feature (630)..(630): n is a, c, g, or t
  modified_base (720)..(720): a, c, t, g, unknown or other
  misc_feature (720)..(720): n is a, c, g, or t
  modified_base (727)..(727): a, c, t, g, unknown or other
  misc_feature (727)..(727): n is a, c, g, or t
tcagcgtctagtaccacgaccggtgctcgatttagtctgacgtcaaagggaaagggggcgaggagtcagtctcagtcaggacacagcgtggacatgagggtccccgctcagctcctgggctccttctactctggctccgaggtgccagactgtgacatccagatgacccagtctccatcctccctgtctgacactctggtggganaccagaatcagtcatacacttggcccgggacaagtccaaggccaattcgaacctaaccgttttaaaatggtaactcgtaacgcgtaaggaaacggtaccgaaaggggtaaaaccgtcccccttaaaaacgtttccgtaggtaacttccgtaaagttcggaacttacggaaccctaaaaccccgtttaaaattttaacccggaaaacggttgttaacgggggtaaccttaccccgaaagttaccggttaaaacgggttcttaaacggggtcgggtaccgggtttaggtaaccgttcggggtaacgggggttaccgtagtttttaccaccggtttcaaccgtaccgtaagtccctaaacggcgttaacggtcttacggtactaaacccggtagtaacgtacgttttggaacccgtaacttttacggngtactacgaaccgttaggtactaccgtactaccgtactagtttcgaccgaggtacacgtactgaaccatcaactaggtactggactcggntaacccnaacgttcggtcttaacg

SEQ ID NO: 170134 - DNA, 649 bp, Homo sapiens
  misc_feature: GYAE6OF02GBYHY.14.30.C08.1.454.CMB.1.raw
tcagcgtctagtaccacgaccggtgctcgatttagtctgacgtcaaagggaaagggggcaggagtcagtctcagtcaggacacagcgtggacatgagggtccccgctcagctccctggggctccttctactctggctccgaggtgccagatgtgacatccagatgacccagtctccatcctccctgtctgcatctggtggagacagatcagcatcacttgccggacaagtcaggccagttcgactaccttttaatggtatcagtcagagccagggaactacccctaactctagatctatgagtgacctaacctaattacaaagtagtacgggtactaccgattacgtaaggttacgacggtcgggtacgggttacgtacggttacggtagggggtaccggtatttaccgtaccgttacccgactaacccgtagtcccaaggtcctacggttcctacgtacctaaccgttagtaacgttagtttacggcgttacgttaacgttcggtacgttacgtaacgtacgggttatacctaacgtaacccgttacttaacggtttcggaacccgtagggaacctagccgtagactacgtacgtaacgtaaccgtacgttggtccgacgtcggtaccacgttactacttgttacccg

SEQ ID NO: 170135 - DNA, 609 bp, Homo sapiens
  misc_feature: GYAE6OF02FXLUQ.14.30.C08.1.454.CMB.1.raw
  modified_base (405)..(405): a, c, t, g, unknown or other
  misc_feature (405)..(405): n is a, c, g, or t
tcagcgtctagtaccacgaccggtgctcgatttagtctgacgtcaaaagggaaagggggcaggagtcagtctcagtcaggacacagcgtggacatgagggtccccgctcagctcctggggctccttctactctggctccgaggtgccagatgtgacatccagatgacccagtctccatccctccctgtctgcatctgtgggagacagaatcagcatcacttgccgggcaagtcaggccattgacaccctttaaattggtatcagcagaagccagggaaacgcccctaaacttctgatctatgatgaccaacaatttaacaagatgggatcccatcgaagttcagtggcggtaggatcgtggggcgtattcacgtctcaccatcagcagtctgcaacctgaacgtntttcgacgtacttacgtggtgtcgaaacgtagggttactaccgtaacgtaaacccgttaacgttaccgttttacgggacccgtaacggggaaccctaacgtaccgtaggtaaccaagttacctaaacgttaaacccggtaaaccgttcggttacgggtaccgttacggtaccctaacccgttaacgttaccttcgtttaacccg

SEQ ID NO: 170136 - DNA, 779 bp, Homo sapiens
  misc_feature: GYAE6OF02GBQVZ.14.30.C08.1.454.CMB.1.raw
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
tcagcgtctagtaccacgaccggtgctcgatttagtctgacgtcaaagggaaagggggcaggagtcagtctcagtcaggacacagcgtggacatgagggtccccgctcagcctccgtggggctccttctactctcggctccggaggtcgccagatgtgacatccagatcgaccagtcnccatccctccctgtntgactatctggtgganacgaagtaatcganctatctaccgttcggaccgggactaaacggtcaaccggtacctagttacgaacccttaaccctttttaaaggttagttaacgtaccgtaacggacgtaaacggtaacggacccggaaacggggtaacccgttaacccccgtttaaacgttacgtgtaacttacttacggtatacgtacgaaaccgtaaacctttaaagttaaccgaagacgttaacggaccttacctaagtaccgttaaggtaccgtaggttcgggacgggttgacgttacgggtcgggagttacgttccgcttactcaacgtactagactcgtaacgttcctagaacgtaacgtagtaacgtttacgttacggtacctaacgtttacggtaggttaccgttacgtaacgttaagggtttacctaacgtaaccgttaacccggttagttacccggttaacgtccggaaacgggttaaacctcggggtacttaacggaacctgttaaacccgagtttaaccgtaacgtacggttacgtaccgtctaaccggttaccacgtttcggttaaccttaccg

SEQ ID NO: 170137 - DNA, 777 bp, Homo sapiens
  misc_feature: GYAE6OF02GV9ML.14.30.C08.1.454.CMB.1.raw
  modified_base (106)..(106): a, c, t, g, unknown or other
  misc_feature (106)..(106): n is a, c, g, or t
  modified_base (124)..(124): a, c, t, g, unknown or other
  misc_feature (124)..(124): n is a, c, g, or t
  modified_base (142)..(142): a, c, t, g, unknown or other
  misc_feature (142)..(142): n is a, c, g, or t
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
tcagcgtctagtaccacgaccggtgctcgatttagtctgacgtcaaagggaaagggggcaggagtcagtctcagtcaggacacagcgtggacatgagggtccccgntcagctctgggctccttntactctggctcgaggtcnccagntgtagacatccagatcgacccagtctccatccctccctgtcctgcagttctggnggganacgagactnagcactcnctggccggactagtcgacgtcctagttacaaccttaccgttttaaattcggtacttacgagcaaggtaacgaccgaagggaaacctaccccttaacttcgtagtacttacttatcgtatcgtaacctaaacctttaaatttaaccgaagtacggttacggtacttaacccgtagttaccgtaaggttacgtaaggggttcgggtaccgggtttaggacgggttttacggggtacggggtaccgtttagtttaacccgtaccgttccgtaaacctacccgtacgttacggaaccgtaccggtaacgttccggtaccgtaaccgtaacgttaagggtaaccgttacggttttaccgaccgtttacgtttacgttacggttacgtaccgtaacggttacgttacctaaccgttaccgttaacccgtttacgttaccggttttccggaaccggtaacggtaaccctaacgggttacgacgtaccgtaacgttaccgaaccgttaaaccgtacgttacggttacggtcgtacgacccgttacgtcttacggttcctacg

SEQ ID NO: 170138 - DNA, 899 bp, Homo sapiens
  misc_feature: GYAE6OF02GQV9E.14.30.C08.1.454.CMB.1.raw
  modified_base (879)..(879): a, c, t, g, unknown or other
  misc_feature (879)..(879): n is a, c, g, or t
tcagcgtctagtaccacgaccggtgctcgatttagtctgacgtcaaaggggaaagggggcaggagtcagtctcagtcaggacacagcgtggacatgagggtccccgctcagctcctggggctccttctactctggctccgaggtgccagatgtgacatccagatgacccagtctccatcctcctgtctgcatctggtggagacagaatcgagactatcctacgttggccgggactaagtcgacggcctattcgaaccttaaccctttttaaaagttcggtaattacgaacggtaccgaaggaaccggaccgtaaacgggggaaaaccgtaaccccccgttaaaaacttttcgtacggtaaacttccgttaaattacggtaactaggtaacccctaaaacccttaaatttttaaaccggaaaagggtaacggttaagggggtaaccccttaaccccgtaaaccgtttaaacggtaaaccgggggtttaaccgtaaggggttcgggggtaaccgggggtttaccgggttaacggttaccgggggttaacgggggggtacccgtttaaacgtttttacccgtacccgtttaccgtacccgtaaacccgtacgttaacccgtaacggaccggttaacgttccggtacccgtaaccgttaaacccggttagttaaaacgtttacgttttacgggaaccgtttaccgttttaagttacgggttacgttaaacctaacgggttagggtttaaactaccgttaacccgtttaacccgtagtttaccggtttaccggaaccggtaccgggaaactaaccgtacgtaaggtaccaacgtaaccgtaagttaaccgacggttcggtacgacgtccgtaccttaacccgtntttacccgttacgtttaccg

SEQ ID NO: 170139 - DNA, 743 bp, Homo sapiens
  misc_feature: GYAE6OF02GPMB2.14.30.C08.1.454.CMB.1.raw
  modified_base (300)..(300): a, c, t, g, unknown or other
  misc_feature (300)..(300): n is a, c, g, or t
  modified_base (392)..(392): a, c, t, g, unknown or other
  misc_feature (392)..(392): n is a, c, g, or t
tcagcgtctagtaccacgaccggtgctcgatttagtctgacgtcaaagggaaagggggcgaggagtcagtctcagtcaggacacagcgtggacatgagggtccccgctcagctcctggggcctccttctactctcggctccgtaggtcgccaagatgtgactactccagatcgacccagttcctccatcccctccgtagtctgacctattcctggtacgggaacgacaggtaactccagcctaatctaccggtcgccgggatacggtcgacggctatacgaccttacttaacttgtctanacgtcaacgtacgaccgaaagggtaaccacccctttaactcgagactacgttactagacacgtacgaaccttaattacaagtacgtagtacncccgtaataccgtaaggttaccgagtcggtacggtacgtagttcgacgggggtaacgtttcctacgtaacgttcccaaactcggtactacgtacggaccgttacttcgtaaccgtacgtaacccgttaaggaccggttacgtttacgaccgttacgtttacgttacggtacttacgtaaacggttaggttaacgtacctaaaccgggttaacccttaacgtttcccggtttacggaacccggttaacggttacccgaagtcccgttagaaccgtacgttaacccgtaagttaccggtagtaacggttcgtacctaccgtaaccggtaccttacgttaccggtctttaaccg

SEQ ID NO: 170140 - DNA, 409 bp, Homo sapiens
  misc_feature: GYAE6OF01DHSG3.47.77.G11.1.454.CMB.1.raw
  modified_base (405)..(409): a, c, t, g, unknown or other
  misc_feature (405)..(409): n is a, c, g, or t
tcagagctcacgtacacgaccggtgctcgatttagctagtcactccagggaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctggtcaccgtctcttcagcttccaccaagggcccatcggtcttccccctggcgccctgctccaggagcacctctggggcacagcggccctgggctgcctggtcaaggactacttcctacgtgagctctgagcgggctggcaaggcgcatagnnnnn

SEQ ID NO: 170141 - DNA, 410 bp, Homo sapiens
  misc_feature: GYAE6OF01CAWAD.47.77.G11.1.454.CMB.1.raw
  modified_base (403)..(410): a, c, t, g, unknown or other
  misc_feature (403)..(410): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagctccacaaggcccatcggtctcccctggcgccctgctccaggacgcactctggggcacagcggccctgggctgcctggtcaaggactacttcctaacgtgagctctgagtcgggctggcaaggcgcatacgnnnnnnnn

SEQ ID NO: 170142 - DNA, 430 bp, Homo sapiens
  misc_feature: GYAE6OF01CZNDJ.47.77.G11.1.454.CMB.1.raw
  modified_base (226)..(226): a, c, t, g, unknown or other
  misc_feature (226)..(226): n is a, c, g, or t
  modified_base (404)..(430): a, c, t, g, unknown or other
  misc_feature (404)..(430): n is a, c, g, or t
tcagagctcacgtacacgaccggtgctcgatttagctagtcactcaagggaaaggggcgtggagtgggtctcaggcattggtggtagtggtgccaggacacattacgtaagtccctgcagggccgattctttatctccagagacaattccgaggaacatactgattctgcagttgaccagactgagagtcgaggacacggcgtatatatgtgttaaatgggatggnggctacgactcttggggccgggaacctggtcaaccgtctctcagctaccacaaggccatcggcttcccctgcgccctgctccaggacgcacgtctggggcacagccggcctgggctgcctggcaaagggctaacttccgtaacgtgagctctgagcgggctgggcaaggcgcatagannnnnnnnnnnnnnnnnnnnnnnnnnn

SEQ ID NO: 170143 - DNA, 412 bp, Homo sapiens
  misc_feature: GYAE6OF01B5NB8.47.77.G11.1.454.CMB.1.raw
  modified_base (407)..(412): a, c, t, g, unknown or other
  misc_feature (407)..(412): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctggtcaccgtctcttcagcttccaccaagggcccatcggtcttccccctggcgccctgctccaggagcacctctggggcacagcggccctgggctgcctggtcaaggactacttcctacgtgagctctgagcgggctggcaaggcgcatagnnnnnn

SEQ ID NO: 170144 - DNA, 419 bp, Homo sapiens
  misc_feature: GYAE6OF01CQL2S.47.77.G11.1.454.CMB.1.raw
  modified_base (266)..(266): a, c, t, g, unknown or other
  misc_feature (266)..(266): n is a, c, g, or t
  modified_base (412)..(419): a, c, t, g, unknown or other
  misc_feature (412)..(419): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcaccgtntcttcagctccaccaaggcccatcggtcttcccctggcgccctgctccaggagcacctcgtggggcacgagccggccctgggcctggcctggtcaaggactacttcctacgtgagctcgtgaggcggctgggcaaggcgcagtagnnnnnnnn

SEQ ID NO: 170145 - DNA, 546 bp, Homo sapiens
  misc_feature: GYAE6OF01DWA48.47.77.G11.1.454.CMB.1.raw
  modified_base (423)..(423): a, c, t, g, unknown or other
  misc_feature (423)..(423): n is a, c, g, or t
  modified_base (539)..(539): a, c, t, g, unknown or other
  misc_feature (539)..(539): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctgggtggagtcgtggggggaggcttagtacagccgtggggggtccctgagactctcctgcgcagcctctggattctcctttagtagttatgccatgacttgggtccgccaggctccgaggggaggggctgggagtgggtctcgaggctagttgggtggtagtggtgccgaggacactaagttacgtaaacgtccctgcgagggcctatttcttatcctccaganacaattccaagaacatactgattctgctagttgaaccagactgagagtcgagacacggtctatattatgtagttaaagtgggatggtgcgtagctcggtcggggcccggactggcncgtctcg

SEQ ID NO: 170146 - DNA, 417 bp, Homo sapiens
  misc_feature: GYAE6OF01B7UDG.47.77.G11.1.454.CMB.1.raw
  modified_base (407)..(417): a, c, t, g, unknown or other
  misc_feature (407)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggccggggaacctggtcaccgtctcttcagcttccacaaggccatcggtcttcccctggcgccctgctccaggagcacctcgtggggcacgacgcggccctgggctgcctggtcaaggactacttcctacgtgagctctgagcgggctggcaggcgcatagnnnnnnnnnnn

SEQ ID NO: 170147 - DNA, 441 bp, Homo sapiens
  misc_feature: GYAE6OF01ANF4F.47.77.G11.1.454.CMB.1.raw
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (415)..(441): a, c, t, g, unknown or other
  misc_feature (415)..(441): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatgggtgctacgactcgttgggggcccgggaacctggtcaccgtctcttcagcttccaccaagggcccatcggtctccccctggcnccctgctccaggacncacctcgtgggggccacagcggccctgggctggcctggtcaaggactacttcctacgtgagctctgagcgggctgggcaaggcgcagtagnnnnnnnnnnnnnnnnnnnnnnnnnnn

SEQ ID NO: 170148 - DNA, 434 bp, Homo sapiens
  misc_feature: GYAE6OF01CEH1W.47.77.G11.1.454.CMB.1.raw
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
  modified_base (423)..(434): a, c, t, g, unknown or other
  misc_feature (423)..(434): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttatctcagagacaattccaggaacatactgattctgcagttgaccagactgagagtcgaggacacggccgtatattattgtagttaaatgggatggtggctacgactcgttgggggccgggaaccctgggtcaccgtctcttcagcttcacaaggcccatcggtcttcccctggccgccctgctccaggacgcacctcgtggggccacgaggccggcccgtgggctgcctggtacaagggacctacttcctaggtnacggctcgtgaggcgggctgggacaagggcncatagnnnnnnnnnnnn

SEQ ID NO: 170149 - DNA, 429 bp, Homo sapiens
  misc_feature: GYAE6OF01AQZSM.47.77.G11.1.454.CMB.1.raw
  modified_base (412)..(429): a, c, t, g, unknown or other
  misc_feature (412)..(429): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctgggtcaccgtctcttcagcttccaccaagggcccatcggtcttccccctggcgccctgctcccaggacgcacctctgggggcacagcggccctgggctgcctggtcaagggctacttccacgtgagctctgagcgggctgggcaaggcgcagtagnnnnnnnnnnnnnnnnnn

SEQ ID NO: 170150 - DNA, 415 bp, Homo sapiens
  misc_feature: GYAE6OF01D12GO.47.77.G11.1.454.CMB.1.raw
  modified_base (409)..(415): a, c, t, g, unknown or other
  misc_feature (409)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnnnn

SEQ ID NO: 170151 - DNA, 409 bp, Homo sapiens
  misc_feature: GYAE6OF01BWMWZ.47.77.G11.1.454.CMB.1.raw
  modified_base (403)..(409): a, c, t, g, unknown or other
  misc_feature (403)..(409): n is a, c, g, or t
tcagagctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttcccctggcgccctgctccaggagcacctctggggacacagcggccctgggctgcctggtcaaggctacttccacgtgagctctgagcgggctggcaaggcgcatagnnnnnnn

SEQ ID NO: 170152 - DNA, 414 bp, Homo sapiens
  misc_feature: GYAE6OF01EVJ6E.47.77.G11.1.454.CMB.1.raw
  modified_base (409)..(414): a, c, t, g, unknown or other
  misc_feature (409)..(414): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctatgtatactctgagcgggctggcaaggcgcatagnnnnnn

SEQ ID NO: 170153 - DNA, 417 bp, Homo sapiens
  misc_feature: GYAE6OF01DHP8M.47.77.G11.1.454.CMB.1.raw
  modified_base (406)..(406): a, c, t, g, unknown or other
  misc_feature (406)..(406): n is a, c, g, or t
  modified_base (411)..(417): a, c, t, g, unknown or other
  misc_feature (411)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttatctccagagacaattccaggaacatactgattctgcagttgaccagactgagagtcgaggacacggccgtatattattgtgttaaaatgggatggtggctacgactcgttggggccgggaacctggtcaccgtctcttcagcttccaccaagggcccatcggtcttccccctggcgccctgctccaggagcacctcgtgggggcacgagcggcccgtgggctcgccgtggtcaaggactacttcctacgtgagctcgtgagcggctggcaggcncatgnnnnnnn

SEQ ID NO: 170154 - DNA, 556 bp, Homo sapiens
  misc_feature: GYAE6OF01ELMNQ.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttagtacagcctggggggtccctgagactctcctgcgcagcctctggattctcctttagtagttatgccatgacttgggtccgccaggctccgaggggaaggggctgggaggtgggtctcgaggcagttggtggtagtggtgccaggacacattacgtaaagtccctgcagggccattctttatctcagagacaattccaggaacatactgattctgcagttcaccagactgagagtcgaggacacggccgtatattattgtagttaaagtgggtatgggtggctaacggacgttcgttcgggggacccggggtaaccctgggtcctacccgg

SEQ ID NO: 170155 - DNA, 415 bp, Homo sapiens
  misc_feature: GYAE6OF01C5R0W.47.77.G11.1.454.CMB.1.raw
  modified_base (410)..(415): a, c, t, g, unknown or other
  misc_feature (410)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaaccctggtcaccgtctcttcagcttccaccaagggcccatcggtcttcccctggcgccctgctccaggagcacctctgggggcacagcggccctggggctgcctggtcaaggctacttcctacgtgagctctgagcgggctgggcaaggcgcatagnnnnnn

SEQ ID NO: 170156 - DNA, 418 bp, Homo sapiens
  misc_feature: GYAE6OF01D0Q8W.47.77.G11.1.454.CMB.1.raw
  modified_base (412)..(418): a, c, t, g, unknown or other
  misc_feature (412)..(418): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaaatggggatggtggctacgactcttgggggccggggaaccctggtcaccgtctcttcagcttccaccaagggcccatcggtcttccccctggcgccctgctccaggagcacctctgggggcacagcggccctgggctgcctggtcaaggctacttcctacgtgagctctgagcgggctgggcaaggcgcatagnnnnnnn

SEQ ID NO: 170157 - DNA, 417 bp, Homo sapiens
  misc_feature: GYAE6OF01BVPL8.47.77.G11.1.454.CMB.1.raw
  modified_base (409)..(417): a, c, t, g, unknown or other
  misc_feature (409)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctgggtcaccgtctcttcagcttccacaagggcccatcggtcttccccctggcgccctgctccaggagcacctctggggcacagcggccctgggctgcctggtcaaggactacttcctacgtgagctctggagcgggctgggcaaggcgcatagnnnnnnnnn

SEQ ID NO: 170158 - DNA, 422 bp, Homo sapiens
  misc_feature: GYAE6OF01BW4KV.47.77.G11.1.454.CMB.1.raw
  modified_base (408)..(422): a, c, t, g, unknown or other
  misc_feature (408)..(422): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaacctgggtcaccgtctcttcagcttccaccaaggcccatcggtcttcccctggcgccctgctccaggcgcacctcgtggggcacagcggccctgggctgcctggtcaaaggctacttcctacgtgagctctgagcgggctgggcaaggcgcatagnnnnnnnnnnnnnnn

SEQ ID NO: 170159 - DNA, 415 bp, Homo sapiens
  misc_feature: GYAE6OF01CBNLM.47.77.G11.1.454.CMB.1.raw
  modified_base (410)..(415): a, c, t, g, unknown or other
  misc_feature (410)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttgggggccggggaaccctgggtcaccgtctcttcagcttccaccaagggcccatcggtcttccccctggcgccctgctccaggagcacctctgggggcacagcggccctgggctgcctggtcaaggactacttcctacgtgagctctgagcgggctggcaggcgcatagnnnnnn

SEQ ID NO: 170160 - DNA, 487 bp, Homo sapiens
  misc_feature: GYAE6OF01AJWUQ.47.77.G11.1.454.CMB.1.raw
  modified_base (471)..(472): a, c, t, g, unknown or other
  misc_feature (471)..(472): n is a, c, g, or t
  modified_base (474)..(487): a, c, t, g, unknown or other
  misc_feature (474)..(487): n is a, c, g, or t
tcagagctcacgtacacgaccggtgctcgatttagctagtcactcaaggggaaaggggctggaggtgggtctcaggcattggtggtagtggtggccaggacacattacgtaaagtccctgcagggccgattctttatctccagagacaattccaggaacataactgattctgcagttgaccagactgagagtcgaggacacggccgtatattattgtgttaaatgggatgggtggctacgactcgttggggccgggaacctggtcaccgtcgtcttcagcttccaccaagggcccatccggtcttcccccgtggccgtccctgcctccgacggacgcacctcgtgggggcaccgacgccgggcccgtggggcctcggcccgtcgggtccaaacggggaccttaccgtttcccgtacggtcgaacgtccttcgtcggaggccgggctcgggacgaagggccgcgagtaggcnngnnnnnnnnnnnnnn

SEQ ID NO: 170161 - DNA, 441 bp, Homo sapiens
  misc_feature: GYAE6OF01CD6VP.47.77.G11.1.454.CMB.1.raw
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (429)..(441): a, c, t, g, unknown or other
  misc_feature (429)..(441): n is a, c, g, or t
tcagagctcacgtacacgaccggtgctcgatttagctagtcactccagggaaggggctggagtaggtctcaggcattggtggtagtggtgccaggacacattacgtaaagtccctgcagggccgattctttatctccagagacaattccaggaacatactgattctgcagttgaccagactgagagtcgaggacacggccgtatatttctgtgcgaaagtctatagcagtgccccctagcgcacttctttgacttctggggccagggaatcctggtcaccgtctccacagcctccaccaagggccccatcggtccttccccctggccgccctgctccaggnccacctccgagagcacngcgccctgggctgcctggtcaaggctacttcctacgtgacgctctgagcgggctggcaagggcgcgatagnnnnnnnnnnnnn

SEQ ID NO: 170162 - DNA, 425 bp, Homo sapiens
  misc_feature: GYAE6OF01ATUW2.47.77.G11.1.454.CMB.1.raw
  modified_base (418)..(425): a, c, t, g, unknown or other
  misc_feature (418)..(425): n is a, c, g, or t
tcagagctcacgtacacgaccggtgctcgatttagctagtcactcaagggaaaggggctggagtgggtctcaggcattggtggtagtggtgccaggacacattacgtaaagtcccctgcgagggccgattctttatctccagagacaattccaggaacatactgattctgcagttgaccagactgagagtcgaggacacggccgtatattattgtagttaaagtgggatggtggctacgactcgttggggcccgggaacctggtcaccgtctcttcagcttccacaaggcccatcggtccttcccctggccgccctgctccaggacgcacctcgtggggcacaggccggcccgtgggctcgccgtggtacaaggactacttcctacgtgagctctgaggcggctggcaggcgcatagnnnnnnnn

SEQ ID NO: 170163 - DNA, 414 bp, Homo sapiens
  misc_feature: GYAE6OF01D41WJ.47.77.G11.1.454.CMB.1.raw
  modified_base (407)..(414): a, c, t, g, unknown or other
  misc_feature (407)..(414): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaacctggtcaccgtctcttcagcttccaccaagggcccatcggtcttccccctggcgccctgctccaggagcacctctgggggcacagcggccctgggctgcctggtcaaggctacttcctacgtgagctctgagcgggctggcaaggcgcatagnnnnnnnn

SEQ ID NO: 170164 - DNA, 413 bp, Homo sapiens
  misc_feature: GYAE6OF01D7E33.47.77.G11.1.454.CMB.1.raw
  modified_base (322)..(322): a, c, t, g, unknown or other
  misc_feature (322)..(322): n is a, c, g, or t
  modified_base (408)..(413): a, c, t, g, unknown or other
  misc_feature (408)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtgctacgactcgttggggccgggaaccctggtcaccgtctcttcagcttccaccaagggcccatcggtcttccccctggcgccctgctccaggancacctccgagagcacagcggccctgggctgcctggtcaaggctacttcctacgtgagctctgagcgggctgggcaaggcgcatagnnnnnn

SEQ ID NO: 170165 - DNA, 417 bp, Homo sapiens
  misc_feature: GYAE6OF01AB3QW.47.77.G11.1.454.CMB.1.raw
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (409)..(417): a, c, t, g, unknown or other
  misc_feature (409)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctcagagacaattccaggaacatactgattctgcagttgaccagactgagagtcgaggacacggccgtatattattgtgttaaatggggatggtggctacgactcttggggccgggaacctggtcaccgtctcttcagcttccaccaagggccccatccggtcttccccctggcnccctgctccaggagcacctcgtgggggcacagcggccctggggctgcctggtcaaggctacttccacgtnagctctgagcgggctggcaaggcgcatagnnnnnnnnn

SEQ ID NO: 170166 - DNA, 417 bp, Homo sapiens
  misc_feature: GYAE6OF01BADWY.47.77.G11.1.454.CMB.1.raw
  modified_base (411)..(417): a, c, t, g, unknown or other
  misc_feature (411)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccggtctcttcagcttccaccaagggcccatcggtcttccccctggcgccctgctccaggagcacctctggggcacagcggccctgggctgcctggtcaaggctacttcctacgtgagctctggaggcgggctgggcaaggcgcatagnnnnnnn

SEQ ID NO: 170167 - DNA, 589 bp, Homo sapiens
  misc_feature: GYAE6OF01CHYWL.47.77.G11.1.454.CMB.1.raw
  modified_base (564)..(564): a, c, t, g, unknown or other
  misc_feature (564)..(564): n is a, c, g, or t
  modified_base (572)..(589): a, c, t, g, unknown or other
  misc_feature (572)..(589): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttactctcagagaactaacttccgaaggaacatactgtattctgctagttcgaccagactggagtaggtcggaaggaccgaccgggtaccgttaattaatttagttggttaagtttaaaggtggggtagttgggtcggtaccgtacgtaccgttcgggttcgggggggaccccggggtaaccgttcgggtcctacccgttcttccttcgacgtcctttacccaaccggaaccggggacccacgttccgggttccccctttccccccgtgggccccgccccgttcgcccttcccgagggacgcccacccttcgggtcgggggccacgacggcccgggtcccgtgggctcgccgtggtacgaaacggtccttaccgtttcctacggtggacgtcctcgtaggacgggccgggtcgtcgggacgaaggggcccgtanagtaggcnnnnnnnnnnnnnnnnnn

SEQ ID NO: 170168 - DNA, 435 bp, Homo sapiens
  misc_feature: GYAE6OF01ELFWB.47.77.G11.1.454.CMB.1.raw
  modified_base (425)..(435): a, c, t, g, unknown or other
  misc_feature (425)..(435): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcaccgtctctcagctcacaaggccatcggtcttcccctggccgccctgcctccgaggacgcacctcgtggggcacgagcggccgtgggctcgccgtggtcaacggactacgttcctacgtgacgtctcgtggacggcgggtcgtgggacgaagggcgacgagtagnnnnnnnnnnn

SEQ ID NO: 170169 - DNA, 416 bp, Homo sapiens
  misc_feature: GYAE6OF01DG9GZ.47.77.G11.1.454.CMB.1.raw
  modified_base (324)..(324): a, c, t, g, unknown or other
  misc_feature (324)..(324): n is a, c, g, or t
  modified_base (410)..(416): a, c, t, g, unknown or other
  misc_feature (410)..(416): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggccggggaacctggtcaccgtctcttcagcttccaccaagggcccatcggtcttcccctggccgccctgcctcaggancacctcgtggggcacagcggccctgggctgcctggtcaaggactacttcctacgtgagctctgagcgggctggcaaggcgcatagnnnnnnn

SEQ ID NO: 170170 - DNA, 411 bp, Homo sapiens
  misc_feature: GYAE6OF01BI7SX.47.77.G11.1.454.CMB.1.raw
  modified_base (407)..(411): a, c, t, g, unknown or other
  misc_feature (407)..(411): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggctacttcctacgtgagctctgagcgggctggcaaggcgcatagnnnnn

SEQ ID NO: 170171 - DNA, 410 bp, Homo sapiens
  misc_feature: GYAE6OF01AY0VJ.47.77.G11.1.454.CMB.1.raw
  modified_base (400)..(400): a, c, t, g, unknown or other
  misc_feature (400)..(400): n is a, c, g, or t
  modified_base (406)..(410): a, c, t, g, unknown or other
  misc_feature (406)..(410): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctggggcacagcggccctgggctgcctggtcaaggctacttcctacgtgagctctgagcgggctggcaaggcncatagnnnnn

SEQ ID NO: 170172 - DNA, 413 bp, Homo sapiens
  misc_feature: GYAE6OF01BD0YE.47.77.G11.1.454.CMB.1.raw
  modified_base (408)..(413): a, c, t, g, unknown or other
  misc_feature (408)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnnn

SEQ ID NO: 170173 - DNA, 413 bp, Homo sapiens
  misc_feature: GYAE6OF01AVEKL.47.77.G11.1.454.CMB.1.raw
  modified_base (408)..(413): a, c, t, g, unknown or other
  misc_feature (408)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttccccctggcgccctgctccaggagcacctctgggggcacgagcggccctgggctgcctggtcaaggactacttcctacgtgagctctgagcgggctggcaaggcgcatagnnnnnn

SEQ ID NO: 170174 - DNA, 415 bp, Homo sapiens
  misc_feature: GYAE6OF01DNBA9.47.77.G11.1.454.CMB.1.raw
  modified_base (266)..(266): a, c, t, g, unknown or other
  misc_feature (266)..(266): n is a, c, g, or t
  modified_base (409)..(415): a, c, t, g, unknown or other
  misc_feature (409)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctggtcaccgtntcttcagcttccaccaagggcccatcggtcttccccctggcgccctgcctccaggagcacctctgggggcacagcggccctgggctgcctggtcaaggactacttcctacgtgagctctgagcgggctggcaaggcgcatagnnnnnnn

SEQ ID NO: 170175 - DNA, 443 bp, Homo sapiens
  misc_feature: GYAE6OF01DPTWA.47.77.G11.1.454.CMB.1.raw
  modified_base (265)..(265): a, c, t, g, unknown or other
  misc_feature (265)..(265): n is a, c, g, or t
  modified_base (339)..(339): a, c, t, g, unknown or other
  misc_feature (339)..(339): n is a, c, g, or t
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
  modified_base (427)..(443): a, c, t, g, unknown or other
  misc_feature (427)..(443): n is a, c, g, or t
tcagagctcacgtacacgaccggtgctcgatttagctagtcactcaaagggaaaggggctggagtgggtctcaggcattggtggtagtggtgccaggacacattacgtaaagtccctgcagggccgattctttatctcagagacaattccaggaacatactgattctgcagttgaccagactgagagtcgaggacacggccgtatattatgtagttaaatgggatggtgctacgactcgttggggccgggaacctggtcaccgtntcttcagcttcacaaggccatcgtctcccctggccgccctgcctccgaggacgccaccgtcgtgggggcaacgnggccggcccgtgggctgcctggtacaaggtactacgtttccgtacgtgacgtctcgtggacgcggngtcggacgaggccgataagngnnnnnnnnnnnnnnnnn

SEQ ID NO: 170176 - DNA, 438 bp, Homo sapiens
  misc_feature: GYAE6OF01C3FW7.47.77.G11.1.454.CMB.1.raw
  modified_base (325)..(325): a, c, t, g, unknown or other
  misc_feature (325)..(325): n is a, c, g, or t
  modified_base (417)..(417): a, c, t, g, unknown or other
  misc_feature (417)..(417): n is a, c, g, or t
  modified_base (419)..(438): a, c, t, g, unknown or other
  misc_feature (419)..(438): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttatctccagagacaattccaggaacatactgattctgcagttgaccagactgagagtcgaggacacggccgtatattattgtgttaaatgggatggtggctacgatcgttgggggcccgggaaccctgggtcaccgttctcttcagcttccaccaagggcccatcggtcttccccctggcgccctgctccaggancacctcgtggggcacagcggccctgggctgcctggtcaagggtactacgttcctacgtgagtctctgagcgggctggcgaaggcgcataggnannnnnnnnnnnnnnnnnnnn

SEQ ID NO: 170177 - DNA, 418 bp, Homo sapiens
  misc_feature: GYAE6OF01CDBS4.47.77.G11.1.454.CMB.1.raw
  modified_base (409)..(418): a, c, t, g, unknown or other
  misc_feature (409)..(418): n is a, c, g, or t
tcagagctcacgtacacgaccggtgctcgatttagctagtcactcaagggaaaggggctggagtgggtctcaggcattggtggtagtggtgccagacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaaccctggtcaccgtctcttcagcttccaccaagggcccatcggtcttccccctggcgccctgctccaggacgcacctctggggcacagcggccctgggctgcctggtcaaggactacttcctacgtgagctctgagcgggctggcaaggcgcatagnnnnnnnnnn

SEQ ID NO: 170178 - DNA, 460 bp, Homo sapiens
  misc_feature: GYAE6OF01DVB8J.47.77.G11.1.454.CMB.1.raw
  modified_base (315)..(315): a, c, t, g, unknown or other
  misc_feature (315)..(315): n is a, c, g, or t
  modified_base (434)..(460): a, c, t, g, unknown or other
  misc_feature (434)..(460): n is a, c, g, or t
tcagagctcacgtacacgaccggtgctcgatttagctagtcactcaaggggtaaagggggctggagtcgggtctcgaggcattggtggtagtggtgccagggaccacattacgtaaagtccctgcgagggccgattctttatctccagagacaattccaggaacatactgattctgcagttgaccagactgagagtcgaggacacggccgtatattattgtgttaaatggggatggtggctacgactcgttggggccggggaaccctggtcacgtctcttcagcttaccactaagggcccatcggtcttcccccnggaccgccctgctcccaggacgcacctctcggggcacagcggccctgggctggcctggtcaaaggactacttcctacgtgagctacgtgagcgggctggactaaggtccgacaatacgnnnnnnnnnnnnnnnnnnnnnnnnnnn

SEQ ID NO: 170179 - DNA, 621 bp, Homo sapiens
  misc_feature: GYAE6OF01EKDOB.47.77.G11.1.454.CMB.1.raw
  modified_base (472)..(472): a, c, t, g, unknown or other
  misc_feature (472)..(472): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtggggggtccctgagactctcctgcgcagcctctggattctcctttagtagttatgccatgtacgttgggtccgccgaggctccgaggggaaggggctgggaggtgggtctcgaggctagttgggtggtaggtggtgccgaggacactagttaacgtaaacgtccctagcgacgggcctatttctttatccttccaagacgaactaattccgaaggtaacatacgtgtactttcgngcgtagttcgaccagacctggagagtacggaggacgaccggtacgtattattagttgtaagtttaaaggtgggtagttggggtcgaccgttaacggtaccgttcgggttacgggggaccccggggtaacccgttgggtcccgtacccgg

SEQ ID NO: 170180 - DNA, 413 bp, Homo sapiens
  misc_feature: GYAE6OF01E2KXL.47.77.G11.1.454.CMB.1.raw
  modified_base (408)..(413): a, c, t, g, unknown or other
  misc_feature (408)..(413): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnnn

SEQ ID NO: 170181 - DNA, 645 bp, Homo sapiens
  misc_feature: GYAE6OF01B6HND.47.77.G11.1.454.CMB.1.raw
  modified_base (421)..(421): a, c, t, g, unknown or other
  misc_feature (421)..(421): n is a, c, g, or t
  modified_base (452)..(452): a, c, t, g, unknown or other
  misc_feature (452)..(452): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttctgtggctattttaaaaagtgtccagtgtgaggtgcagctggtggagtcgtgggggaggcttagtacagccgtgggggtccctgagactctcctgcgcagcctctggtattcttcctttagtagttatgccatgtacttcgggtccgccgaggctccgagggaaggggctgggagtgggtctcgaggcagttggtggtagtggtgccgaggacactaagttaacgtaaagtcccgtgcgacgggccgtatttctttancctccagagactaattccaaggaacatactntacttcgtagcctagtttcgaaccagtacgtaggaacggacgttacggaacggtaccgaaccgggtaccgttaagttaacttttagttaggttaaggtttaaaggtgggttaagttcggggtacggtaccgttaacggtacgttcgggttaccgggggacccggggtaaaccccgttggtacccgttacccgg

SEQ ID NO: 170182 - DNA, 749 bp, Homo sapiens
  misc_feature: GYAE6OF01D1FKK.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctatttaaaaagtgtccagtgtgaggtgcagctggtggagtcgtgggggaggtcgttagtacagccgtggggggtccctggagacctcctcctgcgcacgcctctggacttctcctttagttagttatcgccatcgtacgttcggggtcccgccgaggcctccggaaggggaacgggacgtgggaggtgggtctacgaggtctagttgggtggtaggtggtcgaccgaggacacgtaagttaacgtaaacgtcccgtagcgacgggccgttatttctttaactccgtacccgaagtaacgtaactaaactttacccgaagggtaaacctaacttacgttagtaactttcgtacggtacctaggtttacgaaccctaggtaaccgttagggaacggtaacggttacggaacgggtaacccgaccggggtacccgttaagttaaacgttttagtttacgggttaagttttaaaacggtgggggttaagttcggggtacggtaccgttaacggaaccggtttccggggttacgggggggacccccggggtaaacccgttcggggtacccgttacccccggg

SEQ ID NO: 170183 - DNA, 438 bp, Homo sapiens
  misc_feature: GYAE6OF01BS89V.47.77.G11.1.454.CMB.1.raw
  modified_base (428)..(438): a, c, t, g, unknown or other
  misc_feature (428)..(438): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtgctacgactcgttggggccgggacctggtcaccgtctcttcagcttccaccaaggccagtccggtccttccccgtggccgccctgcctccgaggacgccacctcgtcgggggccacgacggccggcccgtgggcctggcctggtcaaggctacttcctacgtgacgctcgtgaggcgggcgtggcgaacggcgcagtagnnnnnnnnnnn

SEQ ID NO: 170184 - DNA, 419 bp, Homo sapiens
  misc_feature: GYAE6OF01B5RC3.47.77.G11.1.454.CMB.1.raw
  modified_base (410)..(419): a, c, t, g, unknown or other
  misc_feature (410)..(419): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctcccaggagcacctctgggggcacgagcggccctgggctgcctggtcaaggctacttcctacgtgagctctgagcgggctggcaaggcgcatagnnnnnnnnnn

SEQ ID NO: 170185 - DNA, 438 bp, Homo sapiens
  misc_feature: GYAE6OF01CNV31.47.77.G11.1.454.CMB.1.raw
  modified_base (425)..(438): a, c, t, g, unknown or other
  misc_feature (425)..(438): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctcagagacaattccaggaacatactgattctgcagttgaccagactgagagtcgaggacacggccgtatattattgtgttaaatgggatgggtggctacgactcgttgggggccgggaacctggtcaccgtctcttcagcttccaccaagggcccatcggtcttccccctggccaccctcctccaagacgccacctcgtgggggcacgagccggccctgggctcgcctggtcaaggactacttccgtacgtgacgctcgtgacgcgggctgggcgaagggcgacagtagnnnnnnnnnnnnnn

SEQ ID NO: 170186 - DNA, 511 bp, Homo sapiens
  misc_feature: GYAE6OF01BERWX.47.77.G11.1.454.CMB.1.raw
  modified_base (483)..(483): a, c, t, g, unknown or other
  misc_feature (483)..(483): n is a, c, g, or t
  modified_base (485)..(486): a, c, t, g, unknown or other
  misc_feature (485)..(486): n is a, c, g, or t
  modified_base (488)..(488): a, c, t, g, unknown or other
  misc_feature (488)..(488): n is a, c, g, or t
  modified_base (490)..(511): a, c, t, g, unknown or other
  misc_feature (490)..(511): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtgctacgactcgttggggccggggaacctggtcaccgtctcttcagcttccaccaaggcccatcggtcttccccctggccgccctcgcctccgaggacgccacctcgtcggggggccacgacggccggcccgtcggggcctcgggccgtcgggtccgaacgggtaaccgttacctttacccgtaaccggtcgtaacggtccttcgttcggaacggccggggtcgttcggggaccgaagggccggccgaagtacggngnngngnnnnnnnnnnnnnnnnnnnnnn

SEQ ID NO: 170187 - DNA, 408 bp, Homo sapiens
  misc_feature: GYAE6OF01BCR9Z.47.77.G11.1.454.CMB.1.raw
  modified_base (261)..(261): a, c, t, g, unknown or other
  misc_feature (261)..(261): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (399)..(408): a, c, t, g, unknown or other
  misc_feature (399)..(408): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactggagagtcgaggacacggccgtatattattgtgttaaatggggatgggtgctagactcgttggggccgggacctggtcnccgtctcttcagcttccaccaagggcccatcggtctcccctggcgccctgctccaggngcnctctggggcacagcgcctgggctncgtgtcaaggactactcctacgtgagctctgagcgggctggcaggcgcntagnnnnnnnnnn

SEQ ID NO: 170188 - DNA, 416 bp, Homo sapiens
  misc_feature: GYAE6OF01D2L2T.47.77.G11.1.454.CMB.1.raw
  modified_base (402)..(402): a, c, t, g, unknown or other
  misc_feature (402)..(402): n is a, c, g, or t
  modified_base (408)..(416): a, c, t, g, unknown or other
  misc_feature (408)..(416): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctggggcacagcggccctgggctgcctggtcaaggactaattcctacgtgagctctgagcgggctggcaaggcncatagnnnnnnnnn

SEQ ID NO: 170189 - DNA, 392 bp, Homo sapiens
  misc_feature: GYAE6OF01ADOZQ.47.77.G11.1.454.CMB.1.raw
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (378)..(392): a, c, t, g, unknown or other
  misc_feature (378)..(392): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttgggggccgggaacctggtcacgtctctcagctccacgaggccatcgtctcccngcncctgcncngncactgngggcangcgcnggctgctgcagctactcagtgagtctcgtgagcggctggacagggcacagtgnnnnnnnnnnnnnnn

SEQ ID NO: 170190 - DNA, 579 bp, Homo sapiens
  misc_feature: GYAE6OF01AF1JG.47.77.G11.1.454.CMB.1.raw
  modified_base (452)..(452): a, c, t, g, unknown or other
  misc_feature (452)..(452): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttagtacagccgtggggggtccctgagactctcctgcgcagcctctggattctcctttagtagttatgccatgacttgggtccgccaggctccgagggaagggctgggaggtgggtctcgaggctagttgggtggtagtggtgccgagggacactagtttacgtaaacgtccctagcgagggccgtatttctttatcctccgagagactaattccaaggaacatactgattcngcagtcgacagctgagagtcgaggacacggcgtattatagttgtagttaaagtggggtattgggtaggctacggtacgttcggttcgggggacccgggtaacccttgggtaccctaccggttctccg

SEQ ID NO: 170191 - DNA, 542 bp, Homo sapiens
  misc_feature: GYAE6OF01DQM06.47.77.G11.1.454.CMB.1.raw
  modified_base (379)..(379): a, c, t, g, unknown or other
  misc_feature (379)..(379): n is a, c, g, or t
  modified_base (500)..(500): a, c, t, g, unknown or other
  misc_feature (500)..(500): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggagcttagtacgagccgtggggggtccctggagactctcctgcgcagcctctggattctcctttagtagttatgccatgacttgggtccgccaggctccgagggaaggggctggagtgggtctcacgtatcaatcctgatggctagtgttaataaattangcgtactcgtggacgggcgattcagcatctcagacgaacaacggcaagagtatactagtatcgtagaatgaacaatcgagagagtcgaacgagtacggctgtctatcgtatttgtgttttnagttcgccgttcgggtccgtagggacttcggtgggtacccgg

SEQ ID NO: 170192 - DNA, 727 bp, Homo sapiens
  misc_feature: GYAE6OF01BH3IY.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctaattttaaaaagtgtccagtgtgaggtgcagcgtggtggagtcgtgggggaggtcgttagtacaggccgtgggggtccctggacgactcctccgtgcgcacgccctcgtggtactttccttaccgttttaggttacgtttatcgtccagttcgtacgtttcggggtccccgccgaacggtcctaccggaaggggaacgggcgtacgggaggtcgggtctacgaggtcgtaggttcgggtggtacggtggtcgacgaggacacgtagttaacgtaacgtcccgtaggacgacgggtcgtactttctttactcctaccgaaggactaacctaaacttccgaaggtaaacctagttactagtactttccgtaggctaggttcgaacccaaggtacctaggacggtaacggtccgggaacgaacccgacggtaccgttaattacgtttagttaggttaacgttaaaggtgggtaattcgggtacgtaccgttaacggtaccggttttccggggccggggggtaaaccccgggtacccgttcgggtaccccgttcccgg

SEQ ID NO: 170193 - DNA, 418 bp, Homo sapiens
  misc_feature: GYAE6OF01CFF6L.47.77.G11.1.454.CMB.1.raw
  modified_base (320)..(320): a, c, t, g, unknown or other
  misc_feature (320)..(320): n is a, c, g, or t
  modified_base (410)..(418): a, c, t, g, unknown or other
  misc_feature (410)..(418): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctgggtcaccgtctcttcagcttccaccaagggcccatcggtcttccccctggcgccctgctccnggagcacctctgggggcacagcggccctgggcctgcctggtcaaggctacttcctacgtgagctctgagcgggctggcaaggcgcatagnnnnnnnnn

SEQ ID NO: 170194 - DNA, 421 bp, Homo sapiens
  misc_feature: GYAE6OF01BFXJL.47.77.G11.1.454.CMB.1.raw
  modified_base (309)..(309): a, c, t, g, unknown or other
  misc_feature (309)..(309): n is a, c, g, or t
  modified_base (413)..(421): a, c, t, g, unknown or other
  misc_feature (413)..(421): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggccgggaaccctggtcaccgtctcttcagcttccaccaagggcccatcggtcttcccctggccnccctgcctccaggagccacctcgtggggcacagcggccctgggctgcctggtcaaggactacttcctacgtgagctctgaggcggctggcgaaggcgcagtagnnnnnnnnn

SEQ ID NO: 170195 - DNA, 575 bp, Homo sapiens
  misc_feature: GYAE6OF01CLXAY.47.77.G11.1.454.CMB.1.raw
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtccgggggaggcttagtacagccgtggggggtccctgagactctcctgcgcacgcctctggattctcctttagtagttatgccatgacttgggtccgccgaggctccgaggggaagggctggagtgggtctcgaggcagttgggtggtagtggtgccaggacacattaacgtaaagtccctgcgaggccgtattcttanctcagagacaattcaggaacatactgattcngctagttgaccagactgagtagtcgaggacacggtccgtatagttattgtagttaaagtgggtnttagggnggtacgtaccggagttccgttagggggggcccccgggtaaaccgttcggtccgacccggttcc

SEQ ID NO: 170196 - DNA, 843 bp, Homo sapiens
  misc_feature: GYAE6OF01DQQFA.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggtcttaattttaaaaagtgtccagtgtgaggtgcagctggtggaggtcgtgggggaggtcttaggtacaggccgtggggggtccctgagactctcctgcgcagcctcgtggtacttcttcctttagtagttatcgccagtcgtaccgttcgggtccccgccgacgggcctaccggaagggggaacggggtccgtggggtagggttcggggtcctcggacggtactaggtttgggtagggttaggttgggtcggacccgaagggtacctaacgtaacgtttaaccggtaaacgtccccgtaggccggtacggggtacccttaattttcctttaagtccctacccgaaggtaacgaaccttaaacgtttcccgaaaaggtaaacctacgttacgttacgttaactttccgtaggtaccgttaggtttacccgaaacccgtaggtaacccgttagaaacgggttacgtaccgggaagggaacccgtaaccggggttacccttaagtttaaccttttaaggtttacgggttaaagttttaaaacgggtgggggttaaagttcgggggttaacggtaccccgttaaaccggttaccggttttacccggggggtttacccgggggggaaccccccggggttaaacccccggttggggttcccccgtaaaccccccgggg

SEQ ID NO: 170197 - DNA, 583 bp, Homo sapiens
  misc_feature: GYAE6OF01D1S0R.47.77.G11.1.454.CMB.1.raw
  modified_base (501)..(501): a, c, t, g, unknown or other
  misc_feature (501)..(501): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgaccttggtctttttcttgtggctattttaaaaagtgtccagtgtgaggtgcagctggtggagtcgtgggggagcttagtacagccgtgggggtccctgagactctcctgcgcagcctcgtggatttctcctttagtagttatgccatgactttgggtccgccaggctaccgaggggaagggctgggagtgggtctcgaggcagttgggtggtagtggtcgcgaggacacagttaacgtaaacgtccctgcgagggtccatttctttatcctccgaagacgaactaattccgaaggaacattacgtgtattctagccgtaagttcgacctagactgagtagtcggaggacncggacttataattagttgtagttaagtgggatgggtgacgtacgcgttcgggtacggggcccgggtaacctggtcctacccg

SEQ ID NO: 170198 - DNA, 413 bp, Homo sapiens
  misc_feature: GYAE6OF01C5STA.47.77.G11.1.454.CMB.1.raw
  modified_base (398)..(398): a, c, t, g, unknown or other
  misc_feature (398)..(398): n is a, c, g, or t
  modified_base (406)..(413): a, c, t, g, unknown or other
  misc_feature (406)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttatctccagagacaattccaggaacatactgattctgcagttgaccagactgagagtcgaggacacggccgtatatattgtgttaaatgggatggtggctagactcgttgggggccgggaacctgggtcaccgtctcttcagcttcaccaaggcccatcggtcttcccctgcgccctgctccaggagcactcgtggggcacagcggcctgggctgcctggtcaaggctacttcctatgtatactctgagtcgggctgggacaacgggngtcatagnnnnnnnn

SEQ ID NO: 170199 - DNA, 653 bp, Homo sapiens
  misc_feature: GYAE6OF01CEQQB.47.77.G11.1.454.CMB.1.raw
  modified_base (495)..(495): a, c, t, g, unknown or other
  misc_feature (495)..(495): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagctggtggagtcgtgggggaggcttagtacagccgtggggggtccctgagactctcctgcgcacgcctcgtggtacttccttcctttagtagttatcgccatgtacgttcgggtcccgccgacggcctccgaagggggaacggggcgtgggaggtgggtctcgaggctagttgggtggttaggtggtcgccgaaggacaacgtaagttaacgtaaacgtccctaggccgacgggccgtatttctttatcctaccagacgtactaacttccgaaggaactatactgtattcngcctagttcgaaccagtactggagacggtacgaacggaccgacgggtaccttaattatttagttaggttagtttaaaagtggggaattgggtcggaccgttacggtacgttccgggttacggggggaccccgggtaacccttgggtacccgtacccgg

SEQ ID NO: 170200 - DNA, 413 bp, Homo sapiens
  misc_feature: GYAE6OF01DQWRF.47.77.G11.1.454.CMB.1.raw
  modified_base (408)..(413): a, c, t, g, unknown or other
  misc_feature (408)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttgggggccggggaaccctgggtcaccgtctcttcagcttcaccaagggcccatcggtcttcccctggcgccctgctccaggagcacctctggggcacagcagccctgggctgcctggtcaaggactacttctacgtgagctctgagtcgggctggcaaggcgcatagnnnnnn

SEQ ID NO: 170201 - DNA, 419 bp, Homo sapiens
  misc_feature: GYAE6OF01ERMTY.47.77.G11.1.454.CMB.1.raw
  modified_base (405)..(419): a, c, t, g, unknown or other
  misc_feature (405)..(419): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctggtcaccgtctcttcagcttccaccaagggcccatcggtcttccccctggcgccctgctccaggagcacctctgggggcacagcggccctgggctgcctggtcaaggctactctacgtgagctctgagcgggctggcaaggcgcatagnnnnnnnnnnnnnnn

SEQ ID NO: 170202 - DNA, 415 bp, Homo sapiens
  misc_feature: GYAE6OF01BSH01.47.77.G11.1.454.CMB.1.raw
  modified_base (409)..(415): a, c, t, g, unknown or other
  misc_feature (409)..(415): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttgggggccgggaaccctggtcaccgtctcttcagcttccaccaaggcccatcggtcttcccctggcgccctgctccaggagcacctctgggggcacgagccggccctgggctcgccgtggtcaaggactaccttccgtacgtgagctctgagcggctggcaggcgcatgnnnnnnn

SEQ ID NO: 170203 - DNA, 584 bp, Homo sapiens
  misc_feature: GYAE6OF01B1L4O.47.77.G11.1.454.CMB.1.raw
  modified_base (348)..(348): a, c, t, g, unknown or other
  misc_feature (348)..(348): n is a, c, g, or t
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcaactgttggagtcgtgggggagacttagtacacccgtggggggtccctgagactctcctgtgcagcctctggactcacctttagcaactctgtcatgggctgggtccgccaggcgtccgggggaagggctggagtgggtctcgaagtnttgatgagaagtggtaggaagcaacatttccgtacggtcgtaactccgtaggaacgggtcccgttcaccgatcctacagagactaatttcaggacncacgctgtatctaacaagtcgaacncgtctagaagacggaccgaggaaccgacggtccgtattacttacgtggtagacgtaaaagttcctaagtacgcacggtcaccccccgtacgctacctacctttcgttgtaacccg

SEQ ID NO: 170204 - DNA, 421 bp, Homo sapiens
  misc_feature: GYAE6OF01C3EJF.47.77.G11.1.454.CMB.1.raw
  modified_base (264)..(264): a, c, t, g, unknown or other
  misc_feature (264)..(264): n is a, c, g, or t
  modified_base (412)..(421): a, c, t, g, unknown or other
  misc_feature (412)..(421): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggcgtatatatgtgttaaatgggatggtggctacgactcgttgggggccgggaacctggtcaccgtntcttcagcttccaccaagggcccatcggtcttccccctggccgccctgcctccaggagcacctctggggcacagcggccctgggctgcctggtcaaggactaccttcctacgtgagctcgtgaggcgggctgggcaagggcgcatagnnnnnnnnnn

SEQ ID NO: 170205 - DNA, 421 bp, Homo sapiens
  misc_feature: GYAE6OF01CMG37.47.77.G11.1.454.CMB.1.raw
  modified_base (412)..(421): a, c, t, g, unknown or other
  misc_feature (412)..(421): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggccgccctgcctccaggacgcacctccgagagcacagcggccctgggctgcctggtcaaggctacttccacgtgacgctctggagcgggctggcaaggcgcatagnnnnnnnnnn

SEQ ID NO: 170206 - DNA, 415 bp, Homo sapiens
  misc_feature: GYAE6OF01BYL51.47.77.G11.1.454.CMB.1.raw
  modified_base (406)..(415): a, c, t, g, unknown or other
  misc_feature (406)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaaatgggatggtggctacgactcgttggggccgggaacctggtcaccgtctcttcagcttccaccaagggccatcggtcttcccctggcgccctgctccaggagcacctctggggcacgagcggcctgggctgcctggtcaaggactactcctatcgtatactctgagcgggctggcaaggcgcatagnnnnnnnnnn

SEQ ID NO: 170207 - DNA, 805 bp, Homo sapiens
  misc_feature: GYAE6OF01EEFPY.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtcttttcttgtggcttaatttaaaaagtgtccagtgtgaggtgcagctggtggagtcgtggggaggcttagtacagccgtcgggggtccctgagactctcctgccgcagcctctggtattccttcctttaagttagttatcgacctagtcggtacgttcgggtcccgccgacggtccgtaccggaagggggaacggggcgtgggaggttcgggtctcgaggtcgtagttgggtggtaggtgggtcgaccgaggaccacgtaacgttaaccggtaaacgtccccgtggacggacgggtaccgttagttttcctttaacgtcccgttacccgaagtaacgtaacgtaaacgttacccgaaaggtaaacctaacttaaccgttagtactttaccgtagtaccgttaacggtttacgaacccgtaaacggtaccgtaaggaacggtaacgggtaccgggaaagggtaacccgaaccgggtaactaaggtttaaacgtttaagttttaacgtttaaggtttaaagggttaaaaacggttggggggttaaagttcggggttaccggtacccgttaaaccgggttacccggtttaccgggggttacccgggggggaacccccgggggttaaaccccgttcggggttaaacccccg

SEQ ID NO: 170208 - DNA, 430 bp, Homo sapiens
  misc_feature: GYAE6OF01B1408.47.77.G11.1.454.CMB.1.raw
  modified_base (418)..(430): a, c, t, g, unknown or other
  misc_feature (418)..(430): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttgggggccggggaacctggtcaccgtctcttcagcttccaccaagggcccatcggtcttccccctggcgccctgctccaggacgcacctcgtgggggcacgagcggccctgggctgcctggtcaaggactacttcctacgtgacgctcgtgaggcgggctgggcaaggcgcagtgnnnnnnnnnnnnn

SEQ ID NO: 170209 - DNA, 579 bp, Homo sapiens
  misc_feature: GYAE6OF01B1NA0.47.77.G11.1.454.CMB.1.raw
  modified_base (423)..(423): a, c, t, g, unknown or other
  misc_feature (423)..(423): n is a, c, g, or t
  modified_base (450)..(450): a, c, t, g, unknown or other
  misc_feature (450)..(450): n is a, c, g, or t
  modified_base (472)..(472): a, c, t, g, unknown or other
  misc_feature (472)..(472): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttctgtggctattttaaaaagtgtccagtgtgaggtgcagctggtggagtcgtgggggaggcttagtacagcctggggggtccctgagactctcctgcgcagcctctggattccttcctttagtagttatgccatgacttgggtctgccaggctccgaggggagggctgggagtgggtctcgaggctagttggtggtaggtggtgccagggacactattaacgtaaacgtccctgcgagggccgtatttcttatctccaganactaattccaagaacatactgacttcngctagttcgacagactggaagngtcgagacgacggcgtaattagttattaggtaagttaagtggggtatgggtcggtacttacggtaccttcgggttacggggggaccccgggtaaccgtgggtacccg

SEQ ID NO: 170210 - DNA, 730 bp, Homo sapiens
  misc_feature: GYAE6OF01C4K1U.47.77.G11.1.454.CMB.1.raw
  modified_base (325)..(325): a, c, t, g, unknown or other
  misc_feature (325)..(325): n is a, c, g, or t
  modified_base (665)..(665): a, c, t, g, unknown or other
  misc_feature (665)..(665): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggacttaattttaaaaagtgtccagtgtgaggtgcagctggtggagtcgtggggagcttagtacagccgtgggggtccctgacgactctcctgcgcagcctcgtggtacttccttaccgtttagtagtttatcgacctaagtcgtaccgttcgggtcccncccgaacgggtccttaccggaaggggacggcgtgggacggtggtactcgagggtctaggtttgggaggttagtggggtacgccgtaggaacctaagtacgtttaaaccggtaaacgtcccctaggacccgacggggtcttaacgtttactttaactcccgtaacaggtaactacctaacgttacccgaaggtaaactaattaaccgtagtaactttcccgtagtaccgttacgttacaacccgtaaggtcctaaggaacggtacgtacggaaccgggtaacacccgggtacttaactttagtttaacgttagtttaaggtaaaagtgggtagttacgggngttactaccggacgttcggggtaacccggggtacccgggtacctgggtaccctcgttccgttacg

SEQ ID NO: 170211 - DNA, 813 bp, Homo sapiens
  misc_feature: GYAE6OF01C2Z1I.47.77.G11.1.454.CMB.1.raw
  modified_base (732)..(732): a, c, t, g, unknown or other
  misc_feature (732)..(732): n is a, c, g, or t
tcagagctcacgtacacgaccggtgctcgatttagctagtcactcaagggaaaggggagctctgagagaggagcccagccctgggattttcaggtgttttctatttggtgatcaggactgaacagagagaactcaccatggagtctgggctgagcttgggttttccttgttgcttacttttaaaaggtgtcctagtgtgaggtgcgaggtagtggacggtccgggggagtcttagttcagccgtgggagtcctgagactctcctagtgtagtctcgtaggtaatcgtagtttacgagttaccttcgtggtactcgtccgtacgttcgggtacccgaccgtaaaaccgtccgagggtaacggggtccgtagggttggttcgggtcctacgtacggttactacgtaactccgtagtacgttcggacgtaggttagtttaaagtttaaagtttacgtacggtaccggtaccgttccggtacgggtaccgggtacgttaactttacggaacggtcctaacgttccccgaacggaaacgtaacgaaaccggtaaacgggtaacctaaaggttaacgttaaacgttaaccgtttagggtaacttaccgggttaaaggaaacttaacggaaaacccgttaatttaccggaaggtaaacgtacggtaccggaaacgttaccggtaccggttacgttacggtaacttacgttaacgttggttttagtttaccggtttaacncgggtttacccggtcccgtttaaccggggtcccggacccggtttacggttcccgggttcggggacccggttaaccccgggg

SEQ ID NO: 170212 - DNA, 615 bp, Homo sapiens
  misc_feature: GYAE6OF01EESFZ.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtgggggtccctgagactctcctgcgcacgcctctggattcctcctttagtagttatgccatgacgttcgggtccgccgacggcctccgaagggggaaggggcgtgggagtgggtctcgaggctagttgggtggtagtggtgccgagacactagttacgtaacgtccctgacgacggctattctttatccttaccgaagacgactaacgttccaaggtaacatactgtattctgactagttacgaacgtagactgagtaggtacgacggacgacggacgttaatattagttggttaagtttaaagtcggggtaattcggggtgacgttacgtacgttcgggtaccgggggacccgggtaacccgttgggtccctacccgg

SEQ ID NO: 170213 - DNA, 628 bp, Homo sapiens
  misc_feature: GYAE6OF01CM1RB.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctattttaaaaagtgtccagtgtgaggtgcagctggtggagtcgtgggggaggcttagtacaggccgtggggggtccctgacgactctcctgcgcagcctctggactcacctttagcaactctgtcagtgggctcgggtccgccgaggccgtccgggggaaggggccgtgggaggttcgggtctacgaagttagttgagtgaagaagtgggtaggaagcaactagttccgtacggtggtaccgtccggtaggaacggggtcccgttaccgacctactcctaccgagaacgtaactaatttacgaacggagcgacgtctagtactactaacaaatacgaacacgaccgtagaacgacggaccgaggaccgacggtacccgttattacgtttcgtggtacgtacggtaaagtctaagtacgctacgtacccgacccccgtacgccgtctaccgtttccg

SEQ ID NO: 170214 - DNA, 673 bp, Homo sapiens
  misc_feature: GYAE6OF01D2S3V.47.77.G11.1.454.CMB.1.raw
  modified_base (198)..(198): a, c, t, g, unknown or other
  misc_feature (198)..(198): n is a, c, g, or t
  modified_base (364)..(364): a, c, t, g, unknown or other
  misc_feature (364)..(364): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (550)..(550): a, c, t, g, unknown or other
  misc_feature (550)..(550): n is a, c, g, or t
tcagagctcacgtacacgaccggtgctcgattttagctagtcactcaaggggaaacggggactggacgtgggtcgtcaggccattggtggtagtggtgcccaggaccacagtttaaccgtaaaggtcccctggcagggccgtattttctttagtctccagagacaattccaggaacactactgattctgcagtgaccngacgtgagagtcgaggacacgggccgtatacttagttgtagttaagtgggatgggtgtccttacgtacgttcggtttcggggacccgggtacctgggtaccaccggttctcgtttcgacgtccttacccgaacggaacgggccctaggtccggtcctttcccccgngggccgtcccgtgccgtccgaggacgcctaccgtcggtcgggactacgacgccggccgtgggcctgtccgtaggaccgaaggtaccttacgttaccgaacgtcgacggtcctacgacgggtggacccgggtcgtacgggaccgaacgggccgacgtaagtcggacngacgngagcgngacgngcgngacgtgcatacagtagtagtacgtacgacgacgacggtacgtacgtagtacgtacgttagttacggtacgttaggttacggtcgttagtacgtcgttcttacgttagttcgttggtcgtacgg

SEQ ID NO: 170215 - DNA, 696 bp, Homo sapiens
  misc_feature: GYAE6OF01EMNZG.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagctggtggagtcgtgggggaggcttagtacagccgtgggggtccctgagactctcctgccgcacgcctcgtggactttcctcctttagtattatcgcctagtgacgttcgggtccgtccgaggccgtccggagggggaacggggcgtacgggaggttgggtctcgaggctagttgggtggtagtgggtcgcgagacactagtttaacgtaaacgtccctgcgtaacgggtccgtatttcgtttaactccgtaccgtagaacaactaactttccgaaaggtaaactagtaaccttagactttcgagtccgtaaggttcgaaccaaggtaccgtaggaaggtacgtacggagggtaacccgacgggtacctaatttacgtagtttggtaacggttaaagtggggtacttcgggtaggttacccgttaccggtacgttccgggttaccgggggggacccccgggtaaaccgttccgggtacctccccggttagttcccg

SEQ ID NO: 170216 - DNA, 789 bp, Homo sapiens
  misc_feature: GYAE6OF01EY34Y.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctctttcttgtggtactttttaaaaggtgtccagtgtgaggtgcaacgtgttggagtcgtgggggagacttagtacacccgtgggggtccctgagactctcctgtgcagcctcgtggactctacctttagctaactctgtcagtgggctcgggtcccgccgagggtccggtaccggggggaaacggggcgttagggtacggtcggggtactaccgtaaaggttattaggaagtggtaaggaaggttaggggttacgggaaagacccgtaacttaacgtttaccgttaacgggttacgggaaccctttcccggggtaagggaaaccgggggttccccggtttaaccaacccgtaacgttacccgtacccgtaacggtaacgtaaccgttaaagttttacccgaacggggtaacgaccgtaaccggaccgttacggttaaactttacccgtaaacgtaaacgtaacggtaaaccacggtacccttagggaacggtaacggacccgggaagggtaacccgaccggtaaccgttagtacgtttacgtcgttacggaacgtaaagttccttaagtacgtccgtaacgtcccgtaccccgtaccgaccgtaccttaccgtttcgttaccgttaccggg

SEQ ID NO: 170217 - DNA, 523 bp, Homo sapiens
  misc_feature: GYAE6OF01CU9CB.47.77.G11.1.454.CMB.1.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttctgtggctaattttaaaaagtgtccagtgtgaggtgcagctggtggagtcgtgggggaggcttagacagcctggggggtccctgagactctcctgtgcagcctctggactcacctttagcaactctgtcatgggctgggccnccaggctccggggaagggctggagtgggtctnaagtattgatgagaatggngaagnacattcaacgtggactcgtgaagggccgttnaccatctccagagacaatttcaggagcagcngtatctaacaaatcgaacagtctggaacgagcccgaggacacggccgtattattctgtgacgaaagtctatagcagtcgccccctaagccgctactttcg

SEQ ID NO: 170218 - DNA, 502 bp, Homo sapiens
  misc_feature: GYAE6OF01DRX42.47.77.G11.1.454.CMB.1.raw
  modified_base (274)..(274): a, c, t, g, unknown or other
  misc_feature (274)..(274): n is a, c, g, or t
  modified_base (481)..(484): a, c, t, g, unknown or other
  misc_feature (481)..(484): n is a, c, g, or t
  modified_base (486)..(502): a, c, t, g, unknown or other
  misc_feature (486)..(502): n is a, c, g, or t
tcagagctcacgtacacgaccggtgctcgatttagctagtcactcaagggaaagggggctggagtgggtctcaggcattggtggtagtggtgccaggacacattacgtaaagtccctgcagggccgattctttatctccagagacaattccaggaacatactgattctgcagttgaccagactgagagtcgaggacacggcgtatattattgtagttaaatgggatggtgctacgactcgttcggggccgggaaccctggtcaccgtctcttcngtccttccaccgaacgggcccagtccggttccttcccccgtggcccgcccctcgcctccgagggacgccacccgtcggtcgggggccacgacggccggtccccgtggggcctcggccgttggtaccgaaacggtaccttaccgttccgtacggtgacgtctcgtgggacggcggggtcgtcgggacgagggtccgacgaagtacggnnnngnnnnnnnnnnnnnnnnn

SEQ ID NO: 170219 - DNA, 414 bp, Homo sapiens
  misc_feature: GYAE6OF01BM39Q.47.77.G11.1.454.CMB.1.raw
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (391)..(391): a, c, t, g, unknown or other
  misc_feature (391)..(391): n is a, c, g, or t
  modified_base (407)..(414): a, c, t, g, unknown or other
  misc_feature (407)..(414): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaaatgggatggngctagactntgggccgggaacctggtcaccgtctcttcagtcttccaccaagggcccatcggtcttccccctggcgccctgctccaggacgcacctcgtggggcacagcggccctgggctgcctggtcaaggactacttcctacgtgagctctgaggcgggntggcaaggcgcatagnnnnnnnn

SEQ ID NO: 170220 - DNA, 727 bp, Homo sapiens
  misc_feature: GYAE6OF01DO6H4.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctatttaaaagtgtccagtgtgaggtgcagctggtggagtcgtgggggaggcttagtacagccgtggggggtccctgagactctcctgcgcagcctctggtacttctcctttagtagttatgccatgacgttgggccgccaggctccgaggggaagggcgtgggagtgggtctcgaggctagttggtggtagtggtgccgaggacactattaacgtaaacgtccctagcgagggcctatttctttatcctccgaagacgaactaacttccgaagggtaaacaccttaacgtagtaacttttccgtaggtaccgtaaggtttacgaaccctaacgggtaacttagggaaacggtaacgggttccgggaaacgggaacccgtaccggggtacccgtttaaagttaacttttaaggttacgggtttaaggtttaaaaaggttcgggggtaagtttggggttacgggaacccgtttaaccgggtaaccgtttcccggggtttacggggggggtacccccgggggtaaacccccgttggggttaaccccgttaaccccggg

SEQ ID NO: 170221 - DNA, 412 bp, Homo sapiens
  misc_feature: GYAE6OF01AX5P0.47.77.G11.1.454.CMB.1.raw
  modified_base (408)..(412): a, c, t, g, unknown or other
  misc_feature (408)..(412): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatggggatggtggctacgactcttggggccgggaaccctggtcaccgtctcttcagcttccaccaagggcccatcggtcttccccctggcgccctgctccaggagcacctctgggggcacagcggccctgggctgcctggtcaaggctacttcctacgtgagctctgagcgggctggcaaggcgcatagnnnnn

SEQ ID NO: 170222 - DNA, 415 bp, Homo sapiens
  misc_feature: GYAE6OF01EUYGG.47.77.G11.1.454.CMB.1.raw
  modified_base (322)..(322): a, c, t, g, unknown or other
  misc_feature (322)..(322): n is a, c, g, or t
  modified_base (380)..(380): a, c, t, g, unknown or other
  misc_feature (380)..(380): n is a, c, g, or t
  modified_base (407)..(415): a, c, t, g, unknown or other
  misc_feature (407)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaaccctggtcaccgtctcttcagcttccaccaagggcccatcggtcttccccctggcgccctgctccaggngcacctcgtgggggcacagcggccctgggctgcctggtcaaggactactctacgtganctctgagcgggctggcaggcgcatagnnnnnnnnn

SEQ ID NO: 170223 - DNA, 445 bp, Homo sapiens
  misc_feature: GYAE6OF01ES5UR.47.77.G11.1.454.CMB.1.raw
  modified_base (429)..(445): a, c, t, g, unknown or other
  misc_feature (429)..(445): n is a, c, g, or t
tcagagctcacgtacacgaccggtgctcgatttagctagtcactcaagggaaaggggctggagtggggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcacgtctctcagcttccaccacggccatcggtccttcccctggccgtccctgcctccgaggcgcaccgtcgtgggggcacgacggccggcccgtgggctcggccgtggtacgaaggtactacttcctatcgtatactcgtagaggcgggctggacgaaggcgacatagnnnnnnnnnnnnnnnnn

SEQ ID NO: 170224 - DNA, 846 bp, Homo sapiens
  misc_feature: GYAE6OF01C9L37.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaagtgtccagtgtgaggtgcagctggtggagtcgtgggggagcgttagtacagccgtgggggtccctgagactctcctgcgcagtcctcgtggtacttccttaccttttaagttagttactcgcctagtcgtacgtttgggtcccgccaggcctccggaggggaacgggcgtgggacggttgggtctacgaggtctagttgggtaggttaggttgggtcgacccggtaacggaacctaacgttaacgttaaaccggttaaaccggttccccgtaggaccggtaacgggtacccgttaacgttttccttttaacgtcccttaaccgtaacggtaacgtaaacccttaaacgtttaccgaaacgggtaaaacctctttaaccgtgttaacgtttccgtacggtaccgtaacggtttaccgaaccccgtaaggtaacccgttaagggtaacggtacggggttaacccggaacggggtaacccgtaccggggtacccgtttaaaatttaccggttttaaaggtttagggttttaaaggttaaagggttgggggtaacgtttggggttccgggtaaccggttaaccggttaccgggttttacgggggtccccgggggggttaaaccccggggtaacccctttcggggggttaccccctttaaccccggg

SEQ ID NO: 170225 - DNA, 814 bp, Homo sapiens
  misc_feature: GYAE6OF01CG9JB.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctattttaaaaagtgtccagtgtgaggtgcagctggtggagtcgtgggggagtcttagtacagccgtggggggtccctgagactctcctgcgcagcctctggtacttctcctttagtattatcgacctagtgtacgttcgggtccgtccgacggtcctaccgaggggaacgggcgtagggaggttgggtctcgaggctaggttgggtggtacggtgggtacgcccgaaggaacctacgtaagtttaaccggtaaacgtccctaggaccgtaagggacccgtacgtttccttttaagtcccttacccggtaaggtaaccgtaaccttaaacgtttacccgaaagggtaaaccctattaaccgttagttaactttccgtagtaccgttaacggttacgaaacccgtaagtaccgttagggtaaacggtacggtaaccggtaaggggaaaccctacccgggggttaaccttaagttaacggttttaaacgtttaccgggtttaaaggtttaaagggttcgggggtaaacggttttcggggtcgggtaaacccgttaccccgggttaacgggttacccggggtttacccggggggggtacccccgggggttaaacccccggttggggtttacccccgtaaccccggg

SEQ ID NO: 170226 - DNA, 536 bp, Homo sapiens
  misc_feature: GYAE6OF01CW40V.47.77.G11.1.454.CMB.1.raw
  modified_base (507)..(536): a, c, t, g, unknown or other
  misc_feature (507)..(536): n is a, c, g, or t
tcagagctcacgtacacgaccggtgctcgatttagctagtcactcaaggggaaaggggctggagtgggtctcaggcattggtggtagtggtgccaggacacattacgtaaagtccctgcagggccgattctttatctccagagacaattccaggaacatactgattctgctagttgaccagactgagagtcgaggacacggcgtatattattgtagttaaatgggatggtggactacgtactcggttcggggccggggtaaccgtggtctaccgtctcttcacgtccttccaaccgtaacgggccctacgttccggtccctttcccccgtcggccctacccctccgtaccaacggccgtcctaccgtccgggtcgggggcaaccgcggccgggccgtgggcctcggccgttacggtacgaacggtacctttacgttcccgtaacgtgtacgtcttcgtcgggacggtccgggtacgtacgggaacgacggggccgtacgaagtgacnnnnnnnnnnnnnnnnnnnnnnnnnnnnnn

SEQ ID NO: 170227 - DNA, 415 bp, Homo sapiens
  misc_feature: GYAE6OF01EO1ZC.47.77.G11.1.454.CMB.1.raw
  modified_base (407)..(415): a, c, t, g, unknown or other
  misc_feature (407)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcaccgtctcttcagcttccaccaagggcccatcggtcttcccctggcgccctgctccaggacgcacctcgtgggggcacgagcggccctgggctgcctggtcaaggactacttctatgtatacttgagcggctggcaaggcgcatagnnnnnnnnn

SEQ ID NO: 170228 - DNA, 836 bp, Homo sapiens
  misc_feature: GYAE6OF01CF3W2.47.77.G11.1.454.CMB.1.raw
  modified_base (265)..(265): a, c, t, g, unknown or other
  misc_feature (265)..(265): n is a, c, g, or t
tcagagctcacgtacacgaccggtgctcgatttagctagtcactcaagggaaaggggctgagagaggagcccagccctgggattttcgaggtgttttcatttggtgatcaggactgaacagagagaactcaccatggagtttgggctgacctggctttttcttgtggctattttaaaaagtgtccagtgtgaggtgcagctggtggagtctgggggaggcttagtacagccgtggggggtccctgagtactctctgcgcagcctntggattctcctttagtagttatgcctatgtacgttgggtccgccaggtcctaccgagggaacggggtctagggacggttgggtcctcgaggctagttgggtggtagtggtgaccgagggacacgtaagtttaaccgtaaaacgtccccgtaggaccgtaacggggtaccgttaatttccgtttaactccgttaccgaaggtaacgtaaccgtaaacttttaccccgaaagggtaaacctaacgttaaccgttaggtaacttttccgtaggtacctaacgggttttcgaaacccgtaaggtaacccgttgggaacggtaacgggttacccgggaaacgggtaacccgtaaccggggtaccccgtttaaagtttaacggttttaacgtttacgggttaaacggttttaaaaacggtcgggggttaaagtttcgggggttacgggttaacccgtttaaacccgggtaaacccggttttcccgggggtttaaccggggggggtacccccggggttaaaacccccggtttcggggttaacccccgttaaccccgggttttcccgtttaaccccggg

SEQ ID NO: 170229 - DNA, 575 bp, Homo sapiens
  misc_feature: GYAE6OF01A5LTA.47.77.G11.1.454.CMB.1.raw
  modified_base (310)..(310): a, c, t, g, unknown or other
  misc_feature (310)..(310): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggcttaattttaaaaagtgtccagtgtgaggtgcagctggtggagtcgtgggggaggcttagtacagccgtggggggtccctgagactctcctgcgcagcctctggattctcctttagtagttatgccatgacttgggtccnccgaggcctccgaggggagggctgggagtgggtctcgaggcagttggtggtagtggtcgccaggacactattaacgtaacgtccctgcgagggcctattctttactcctaccagacgacaacttccgaaggaacatactgtacttctgctagttcgaccagactgagagtcgagacgacggctaatattatgtagttaaagtgggtatgggtcgacgtacggacgttcggtcgggggacccgggtacccttgggtccctacccgg

SEQ ID NO: 170230 - DNA, 806 bp, Homo sapiens
  misc_feature: GYAE6OF01C7WTK.47.77.G11.1.454.CMB.1.raw
  modified_base (201)..(201): a, c, t, g, unknown or other
  misc_feature (201)..(201): n is a, c, g, or t
  modified_base (599)..(599): a, c, t, g, unknown or other
  misc_feature (599)..(599): n is a, c, g, or t
tcagagctcacgtacacgaccggtgctcgatttagctagtcactcaagggaaaggggagctctgagagaggagcccagccctgggattttcaggttgttttcatttggtgatcaggactgaacagagagaactcaccatggagtttgggctgacctggtcttttctgtgacttaatttaaaagtgtcagtgtgagtgcagntggtggagtcgtgggggagcttagtacgagccggtgggggtccctgagactctccgtgcgcagcctcgtggtacttccttcctttagttagttactcgacctagtggtacgtttcggggtccccgaccgtacggccgtaccggaagggggtaacggggtccggttgggaacgggttgggtaccgtacggtacgggccgttaggtttggggtaggggttaaggttcgggtacggtacccgaagggtaaccctaacgtaacgtttaaaccggttaaaacgttccccgtagggtacccggaggggtacccgttaacttttcctttaacgtccgttaccgaaacgtacggtaaactaacgtttacccaaagggtaacctagttaaccgtgtaaactttccgngtacgtagttacgaaccgtgtaaccgtaggaacggtaccggtacgggtaaccggaccgtaaccgggttacctaaagtttaacttttagtaaagttaagggttaaacgtggggttacttggggtaccggtaccttaaccgggttacggtttacccggggtacgggggaacccccgggtttaaccccgttggggtaacccccttaccgg

SEQ ID NO: 170231 - DNA, 416 bp, Homo sapiens
  misc_feature: GYAE6OF01B272J.47.77.G11.1.454.CMB.1.raw
  modified_base (221)..(221): a, c, t, g, unknown or other
  misc_feature (221)..(221): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (332)..(332): a, c, t, g, unknown or other
  misc_feature (332)..(332): n is a, c, g, or t
  modified_base (402)..(416): a, c, t, g, unknown or other
  misc_feature (402)..(416): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaaangggatggtggctacgactcgttgggggccgggaacctggtccaccgtctcttcagcttccaccaaggccatcggtctcccctgcgcctnctcaggngcactctggggcacngcggcctggctgcctggtcaaggactactcctacgtgagtctctgagcgggctggacaaggcgacatagnnnnnnnnnnnnnnn

SEQ ID NO: 170232 - DNA, 740 bp, Homo sapiens
  misc_feature: GYAE6OF01BYI73.47.77.G11.1.454.CMB.1.raw
  modified_base (267)..(267): a, c, t, g, unknown or other
  misc_feature (267)..(267): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagctggtggagtcgtgggggaggcttagtacaaccgtgggactccctgagactctcctgtgcagcctntggcttcaccttcaaataattatgctatgcaggtcgggtccgccgaggcctccgaggccgaaagggggctaaggaggttggggtaggcggtacagtactccgtccaaggtcggaactattcgtttacgaagttaacttaccgcaaaggtacccttcccgtagggaacgggggtacccgtaacgtttaccaaccgtaacttacccgtaccgtaaacgaacggaaccttaaacgtttacccccgaaaggtaaaacccgtaaccgggttaaccttaaacttccgttaccgaccctaaccccgttacggaacccctaacggtaccctacgggaaaccgtaaaccgttacggaacccgtaaccgtaaccggttaccttacccttaccgttaaacccgttaacgttcggtaaggccggtaaaggtaacggttaaggtttaacggaaccgtaacgttaccgtaagtttggtggtaaacgg

SEQ ID NO: 170233 - DNA, 460 bp, Homo sapiens
  misc_feature: GYAE6OF01CHKF0.47.77.G11.1.454.CMB.1.raw
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (443)..(460): a, c, t, g, unknown or other
  misc_feature (443)..(460): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttgggggccgggaacctggtcaccgtctcttcagcttcacaaggcccatcggtctcccctggccnccctgctccaggacncacctcgtggggcacgacggccggcccgtgggctcggccgtggtaccaaagggtacctaacgtttccctacggtgagtcctcgtggacggtcgggctgggacaacgggcggacaacgtaggnnnnnnnnnnnnnnnnnn

SEQ ID NO: 170234 - DNA, 466 bp, Homo sapiens
  misc_feature: GYAE6OF01D6DRI.47.77.G11.1.454.CMB.1.raw
  modified_base (308)..(308): a, c, t, g, unknown or other
  misc_feature (308)..(308): n is a, c, g, or t
  modified_base (453)..(466): a, c, t, g, unknown or other
  misc_feature (453)..(466): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttgggggccgggaaccctggtcaccgtctcttcagcttccaccaacggccatccggtccttccccgnggccgccctgcctccgaggacgccaccgtcgtcggggccacgacggccggccgtgggctcgccgtggtacgaacggtaccttacgttccgtacgtgacgtctcgtaggacggcgggtcgtcgggacgaacgggccacgagtacgnnnnnnnnnnnnnn

SEQ ID NO: 170235 - DNA, 418 bp, Homo sapiens
  misc_feature: GYAE6OF01EPA1M.47.77.G11.1.454.CMB.1.raw
  modified_base (309)..(309): a, c, t, g, unknown or other
  misc_feature (309)..(309): n is a, c, g, or t
  modified_base (413)..(418): a, c, t, g, unknown or other
  misc_feature (413)..(418): n is a, c, g, or t
tcagagctcacgtacacgaccggtgctcgatttagctagtcactcaagggaaagggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaacctggtcaccgtctcttcagcttccaccaagggcccatcggtctcccctggccnccctcctccaagacgccacctcgtggggcacacgccggccctgggctgcctggtacaaggactacttctacgtgagctctgagcggctggcgaaggcgcatagnnnnnn

SEQ ID NO: 170236 - DNA, 764 bp, Homo sapiens
  misc_feature: GYAE6OF01EDDRD.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggcttattttaaaaagtgtcagtgtgaggtgcagctgggtggagtcgtgggggaggcttagtacaggccggtcggggggtccctgacgactctcctgcgcacgcctcgtggtacttcttccgttttagtagtttactcgcctagttcgtacgtttcgggtcccgccgaggccgtccggaagggggaacgggggcgtgggaggtcgggtcctcgaggtctagtttgggtaggtaggtgggtcgccgaagggacctacgtaagtttaaccggtaaacgtccccgtggaccggtacgggtccgtaacttttccgtttacgttccctaccgaaggtaacgtaacctaacgtttacccgaaaggtaaacctattaaccgtgtaactttccgtagtaccgtagttacccgaacctaagtaccgtagggaacgtaacgggtccggaagggtaacccgtaccgggtacttaagtttaactttaggtttgtttaagggttaaaggttggggttaagttcggggtaggtaccttaccgggtaccgttccggggttccggggggaccccgggttaacccgttgggttacccctacccggttcttacccgg

SEQ ID NO: 170237 - DNA, 887 bp, Homo sapiens
  misc_feature: GYAE6OF01DBN8F.47.77.G11.1.454.CMB.1.raw
  modified_base (131)..(131): a, c, t, g, unknown or other
  misc_feature (131)..(131): n is a, c, g, or t
tcagagctcacgtacacgaccggtgctcgatttagctagtcactcaagggaaaggggagctctgagagaggagcccagccctgggtattttccgaggtttgttttacagttttggagtactacggacgtanacgaacgaggagacctaacaccaacgttaggaggttttcggggttacgtccgttcggttccgttttcgttttctttttggtaggtttacgtttaaacgttttaaaaagtttaaccggttcccgttaggttaggtaggttaacgtgggtaacgactccgggttaggtgggtacgtacggggttttcgggggaacgtacgtttcgtaaaggccgttccgggggtcccggttacgggtacgtactaccggttccctcgttcggtaccgtacgtccttccgttcgtacggttcttccgttttaccgtaacgtttagttacgtcgtacgtcgttacggttacggttccggttcccggacgtcggtcccggtaacgggtaacgggggcggtcggtacggtcggggttcttaccgtggtacgtagttacggttgggttacggtcggtactcggtacgaaggtaccgtagttaaacggttaacgttaaccggcgtacggacggtaccggtcttaacgtttccgtaactcgtaaccgtaaggaacttaaccgtaccttaacgaaacgtaactgttaaccgtcgttaaccttcgtagtacccgttaaggccgtaactagacggtaagacggttaaccccggagtaaccgtacggtaccgttagattttacgtagttagttacgtaaggttcggaagttggtccggtacgttacggcggtttaccggtaccggggttacccgtaggttccctaacggttccttaccg

SEQ ID NO: 170238 - DNA, 748 bp, Homo sapiens
  misc_feature: GYAE6OF01AMLMG.47.77.G11.1.454.CMB.1.raw
  modified_base (437)..(437): a, c, t, g, unknown or other
  misc_feature (437)..(437): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggaggtttgggctgacctggtctttttcttgtggtcttaattttaaaaagtgtccagtgtgaggtgcagtcgtgggtaggagtcggtggggggaggtcttaggtacaggtccggtcgggggggttccctggaggacctccgtccctggccgcacgtccgtccgttggactttcgttaccgttttagttaaggttactcgacctatcggtacgttcgggtaccgccgaggtccgtacgagggggaacggggtcgtagggtagggtcgggtctcgagggtcctagttggggtggtagtcggggtncccggtaaggacctaatatttaaccgggtaacgtccctggcgacggggtcctaactttcttaactccgccgtaagaaccggtaactaattccccgaaagggtaactaacgttacgtgttaacttcgtggaccttacgggtaccaactaggtacttagggataccgggacgtacgggaaccttaccggggatttaacgtttaatcgtttaggtacgtttaaagggtgggtagttacggggttgacccgttagacccggttttcggggtacgggggccccgggtaactccgggtactaccccgttcgtaaccg

SEQ ID NO: 170239 - DNA, 495 bp, Homo sapiens
  misc_feature: GYAE6OF01ASE1B.47.77.G11.1.454.CMB.1.raw
  modified_base (473)..(495): a, c, t, g, unknown or other
  misc_feature (473)..(495): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaagtgggatggtggctacgacttcgttgggggcccgggaaccctggccaccgtctcttcagctccacacggcccatccggtccttccccgtggccgccctcgcctccgaggcgccacctcggtcggggcacgacgccgggcccgtgggccgtcggccgtggtaccgaagggtaccttaccgttcctacggtcggacgtccttcgtcggacgggtccggggtacgttcggggaccgaacggggccgacgagtaggcnnnnnnnnnnnnnnnnnnnnnnn

SEQ ID NO: 170240 - DNA, 646 bp, Homo sapiens
  misc_feature: GYAE6OF01A6P01.47.77.G11.1.454.CMB.1.raw
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
  modified_base (513)..(513): a, c, t, g, unknown or other
  misc_feature (513)..(513): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggtcttaattttaaaaagtgtccagtgtgaggtgcagctggtggagtcgtgggggaggtcttagtacagccgtgggggtccctgacgactctcctgcgcacgcctctggtacttccttcctttagttagttatcgcctatgtacgtttcggggtcccgccgacgggtccgtaccggaaggggaacggggcgtgggtaggttcgggtctcggaggtctaggtttgggtggtaggtggtcgccgaggacacgtagttaacgtaaacgtcccgtgcgagggtccgtatttcttatcctacgaganactaatccgaagaacntactgtacttcagctagttcgaaccngactggagtacggtacgaaggtaccacggactaattattaatttagttaggttaaagttaaaggtgggaattgggtacgtcgtaacggtccgttcgggttaccggggggacccggttaacccgttggtacccc

SEQ ID NO: 170241 - DNA, 739 bp, Homo sapiens
  misc_feature: GYAE6OF01EF0LB.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagctggtggagtcgtgggggaggcttagacagccgtggggggtccctgagactctccgtgccgcagcctctggtactttcttccttttagtagttatcgcctagtcgtacgtttcgggtccgccgaggcctaccggaaggggaggggcgtgggaggttgggtctcgacggtctaggttggtggtaggtggtcgcccgaggactacgtaacgttaacgtaaacgtcccgtggacgacgggtccttaatttctttactcctaccgaagtaacgtaactaacgttaccgaaggtaacaattaccgtagtactttccgtgacgtaacgtttacgacccgtaaggtacccgttaggaaacggtacggtaacgggaacgggtaacccgtaaccggggtaccgtttaaagttactttaaggttaggtttaagttaaaacgggtggggtaagtttcggggtaggtacccgttaacgggtaccggtttccggggttacccggggggaaccccgggttaaacccgttcgggtaacccgtaccccgg

SEQ ID NO: 170242 - DNA, 495 bp, Homo sapiens
  misc_feature: GYAE6OF01CZXTX.47.77.G11.1.454.CMB.1.raw
  modified_base (222)..(222): a, c, t, g, unknown or other
  misc_feature (222)..(222): n is a, c, g, or t
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
  modified_base (471)..(495): a, c, t, g, unknown or other
  misc_feature (471)..(495): n is a, c, g, or t
tcagagctcacgtacacgaccggtgctcgatttagctagtcactcaagggaaagggggctggagtgggtctcaggcattggtggtagtggtgccaggacacattacgtaaagtccctgcagggccgattctttatctcagagacaattccaggacatactgattctgctagttgaccagactgagagtcgaggacacggccgtatattattgtagttaaagngggatggtcgctacgactcgtcgggggcccgggtaacctggtcaccgtntcttcagtctaccgacgaacgggcccagtcggtccttcccccgtggccnccctcgcctccgaggcgccaccgttggcggggacacgtacgccgggtccgtaggccgtgaccgtggtacgaaacggtacctaccgttccgtaaggtcgacgtcgtacgtggacggtacgggcgtgggaccgaagggtccacggtaatcggnnnnnnnnnnnnnnnnnnnnnnnnn

SEQ ID NO: 170243 - DNA, 1036 bp, Homo sapiens
  misc_feature: GYAE6OF01ESJGC.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttctgtggtcttaattttaaaaagtgtccagtgtgaggtgcagcgtgggtggagtcggtgggggagtcttagtacaggccggtggggggtccctggacgactcctccgtgccgcgacgcctcttggtactttcctcctttagtattatcgacctatgtaccgtttcggggtcccgccgtacggtccgtacccggaaggggggtaacgggggtcgtaggggtaggttcggggttcctaccggtagggtaccgtaaggttttggggtaggggtttaagggttcgggttcggacccggaaggggtaaacctaaccgttaaagtttaaaccggttaaaaacgttcccccgtttaacggaccgggtaaacgggggtcccgtttaacgttttaccctttttaacgttaccccttaacccgtaaggtaacggaaaccctttaaacgtttaaccccgggaaagggtaaaaccctaactttaaaccgggtttacgttaaccgttttaccggttaacggtacccgtttaaacgggttttacccggaaacccggtaacggttaaacccggttaaggggaaaccgggttaacggggttaaccccgggaaaccggggttaacccggtaacccggggttaacccccgttttaaagttttaaaacccgtttttacgggtttttaaaaggggttttaaaggttttaaaaaacgggggtttcggggggttaaagggtttacgggggtttaacggggttacccggtttaaaaccccgggttacccgggtttttaccccggggggtttacccggggggggggtaaacccccccccggggggtttaaccccgggtttaaccccgggggttaccccggtttaaacccccccgggg

SEQ ID NO: 170244 - DNA, 644 bp, Homo sapiens
  misc_feature: GYAE6OF01AZTUW.47.77.G11.1.454.CMB.1.raw
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (430)..(430): a, c, t, g, unknown or other
  misc_feature (430)..(430): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctaattttaaaaagtgtccagtgtgaggtgcagctggtggagtcgtgggggaggcttagtacaggccgtggggggtccctgagactctcctgcgcagcctcgtggtattctcctttagtattatgccatgacttcggggtcccgccgaggcctccgaggggaggggcgtgggagtgggtcncgaggctagttggtggtaggtgggtcnccgaggacactacgttacgtaaacgtccctagcgagggcctatttctttancctacagagactaacgttccaaggaactatactagtattcgcgtactagttcgaaccgtaggactaggaaggacggttacggaacgggtacgaccggtaccgttaattacgtttagttagttaagttaaaggtggggtagttgggtcggtaccgtaacggtaccggttcgggttacggggggaccccgggtaacccgttgggtcccgtacccgg

SEQ ID NO: 170245 - DNA, 421 bp, Homo sapiens
  misc_feature: GYAE6OF01ARKK8.47.77.G11.1.454.CMB.1.raw
  modified_base (410)..(421): a, c, t, g, unknown or other
  misc_feature (410)..(421): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttcccccctggcgcccctgctccaggagcacctctgggggcacagcggccctgggctgcctggtcaaggactacttcctacgtgagctctgagcgggctgggcaggcgcatagnnnnnnnnnnnn

SEQ ID NO: 170246 - DNA, 706 bp, Homo sapiens
  misc_feature: GYAE6OF01CIF9D.47.77.G11.1.454.CMB.1.raw
  modified_base (590)..(590): a, c, t, g, unknown or other
  misc_feature (590)..(590): n is a, c, g, or t
tcagagctcacgtacacgaccggtgctcgatttagctagtcactcaagggaaaggggagctctgagagaggagcccagccctgggattttcaggttgttttcatttggtgatcaggactgaacagagagaactcaccatggagtttgggctgacctggtcttttcttgtggtcttaatttaaaagtgtccagtgtgaggtgcagcgtggtggagtcgtggggagtcttagtacaggccggtggggggtccctagacgtactctccgtgcgcacgcctcgtgtacttcttacctttagtagttatcgaccatcgtacgttcgggtccccgaccgagggtcctacccggaaggggaacggggtcgttagggacggttcgggtacctacggacggtacgttaggttgggtcggttaaggtcgggtcgaccgaacggtaactaacgtaacgtttaaacggtaacgttccccgtaggacggtacgggcccttagtttccttaactccgtaccgaaggaactaaacctaacgttacccgaaggtaaacctagtacccgtagttactttcgacgtactagttacgacccaaggtacnggaaggtacggtacgaaggaccacggtactaattattagttagttaagttaaaggcggtagttcgggtcgtaccgtagtacggtcgggttacggggacccggtactggtccctacg

SEQ ID NO: 170247 - DNA, 632 bp, Homo sapiens
  misc_feature: GYAE6OF01ADINI.47.77.G11.1.454.CMB.1.raw
  modified_base (361)..(361): a, c, t, g, unknown or other
  misc_feature (361)..(361): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctattttaaaaagtgtccagtgtgaggtgcagctggtggagtcgtgggggagcttagtacagccgtgggggtccctgagactctcctgcgcacgcctctggtacttccttcctttagtagttatgcctatcgtacttcgggtcccgccgacggcctaccggaggggaacgggcgtgggtaggtcgggtcncgaggctagttggtggtagtggtcgcgaggacactagttacgtaagtccctgcgacgggtcctatttctttatcctaccagtacgactaacttcgaaggtaacctatacgttagtactttcgtgtactagttcgaaccagtactaggagacgtcgaacggacgacggtaccgtaattattacgttagttaagttaaggtgggtattagggtcgtaccgtacgtaccgttcgggttaccgggggacccgggtaaccgtgggtccctacccgg

SEQ ID NO: 170248 - DNA, 417 bp, Homo sapiens
  misc_feature: GYAE6OF01BNPGU.47.77.G11.1.454.CMB.1.raw
  modified_base (410)..(417): a, c, t, g, unknown or other
  misc_feature (410)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtgctacgactcttgggggccggggaacctggtcaccgtctcttcagcttccaccaagggcccatcgtcttccccctggcgccctgctccaggagcaccgtctgggggccacagcggccctgggctcgcctggtcaagctacttccgtacgtgagctctgaggcgggctggcaaggcgcatagnnnnnnnn

SEQ ID NO: 170249 - DNA, 738 bp, Homo sapiens
  misc_feature: GYAE6OF01D8890.47.77.G11.1.454.CMB.1.raw
  modified_base (471)..(471): a, c, t, g, unknown or other
  misc_feature (471)..(471): n is a, c, g, or t
  modified_base (534)..(534): a, c, t, g, unknown or other
  misc_feature (534)..(534): n is a, c, g, or t
tcagagctcacgtacacgaccggtgctcgatttagctagtcactcaagggaaaggggagctctgagagaggacgcccagccctgggattttcaggtgttttcatttggtgatcaggactgaacagagagaactcaccatggagtttgggctgacctggtctttttctgtgtctaattttaaaaagtgtcagtgtgaggtgcagctgggtggagtcgtgggggagtcttagtacagccggtcgggggtccctgacgtacctctcctgcgcacgcctcgtggtatttccttcctttagtagttatcgacctatcgtaccgttcgggtcccgccgacggtccgtaccggaagggggaaggggcgttgggaggttcgggtctcgacggctagttgggtggtaggtggtgccgaggactaacgtaagttaacggtaaaccgtcccgtagacgacgggtccgttacgtttctttacncccgtaacgaagtaacgtaaccgtaacttaccgaaaggtaactacgttactgttaactttccngtacgtacgttacgaaccgaagtaccgagtaacggacggtaccgaaggacctaccgggactttaaattaacgtttagtttacgttaaaaggtttaaagggtggggtatttacgggggccgaacccggttttaacgacccgggttttccggggtaaccggggggtacccccggggtttaaccccttggggttcccctaaccccgg

SEQ ID NO: 170250 - DNA, 415 bp, Homo sapiens
  misc_feature: GYAE6OF01EOAAS.47.77.G11.1.454.CMB.1.raw
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (304)..(305): a, c, t, g, unknown or other
  misc_feature (304)..(305): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
  modified_base (395)..(415): a, c, t, g, unknown or other
  misc_feature (395)..(415): n is a, c, g, or t
tcagagctcacgtacacgaccggtgctcgatttagctagtcactcaagggaaagggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggccggggtacctggtcaccgtctctcagcttccacaggccatcgtctcccngcnccnnctcnggngcactcgngggcacngcggcctggctcgctgcgagctactctacgtgagctcnggacgcgggctggacgaaggcgacagtagnnnnnnnnnnnnnnnnnnnnn

SEQ ID NO: 170251 - DNA, 469 bp, Homo sapiens
  misc_feature: GYAE6OF01A4FF6.47.77.G11.1.454.CMB.1.raw
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(469): a, c, t, g, unknown or other
  misc_feature (447)..(469): n is a, c, g, or t
tcagagctcacgtacacgaccggtgctcgatttagctagtcactcaagggaaaggggctgggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtgctacgactcgttgggggccggaacctggtcacgtctctcagctcaccgaaggcccagtccgtcttccccnggccgcctgcctccgaggacgccaccgtcgnggggcacgcgccgggccctgggctcggcctggtacaaggtaccttacgttcccgtacggtcgagcccttgtggacggtcgggctcgggacgaagggtccgacgtaagtcgancngnnnnnnnnnnnnnnnnnnnnnnn

SEQ ID NO: 170252 - DNA, 491 bp, Homo sapiens
  misc_feature: GYAE6OF01DCUXU.47.77.G11.1.454.CMB.1.raw
  modified_base (224)..(224): a, c, t, g, unknown or other
  misc_feature (224)..(224): n is a, c, g, or t
  modified_base (477)..(491): a, c, t, g, unknown or other
  misc_feature (477)..(491): n is a, c, g, or t
tcagagctcacgtacacgaccggtgctcgatttagctagtcactcaaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatatttatgttagttaaagnggggatgggtgctacgactcgttgggggccgggacctggcaccgtctcttcagtccttccaccgaacgggccctagtccggttccttcccccgtggcccgtccctcgcctccgaggacgcctacccgtcggtgggggccaacgacggccgggccccgtgggcctcggccgttgggtacaaacgggtaccttactttcccgtagtgacgtctcgtgaggcgggtacgtcgggacgaacgggtccacgtagtagnnnnnnnnnnnnnnn

SEQ ID NO: 170253 - DNA, 721 bp, Homo sapiens
  misc_feature: GYAE6OF01EJL14.47.77.G11.1.454.CMB.1.raw
tcagagctcacgtacacgaccggtgctcgatttagctagtcactcaaggggaaaggggctgagagaggagcccagccctgggattttcaggtgttttcatttggtgatcaggactgaacagagagaactcaccatggagtttgggctgacctggtctttttcttgtggtcttaattttaaaagtgtccagtgtgaggtgcagctggtggagtcggtgggggaggcgttagtacgaggtccggtcggggggtccctggacgtaccttccgtccgtcggccgcacgcctcgtggtacttcttcctttagtagttatgctagtgtacgttcgggtccgccgaggtccgtaccggaagggggtaacggggtcgtacggggtaggtcgggtctacgagggtctaggtttgggtggttaggtcggtcggccgaacgggaacctaacgtaagtttaaaccggttaaaccggtcccgtaggaccggtacggggtaccgttaattttcctttaacgtccctacgaaggtaacgtaacctaacgtttacccgaaaggtaaactacgttacgtacgtattcgtgtactgtaccgactaagactaggagtacggtacggacgtaccgtacggtcgttaattagttagttggttaaagttaagggtggtaaggtggtacggactacggtacgttcgggtacggggacccggtacctccggcttccggtctaccg

SEQ ID NO: 170254 - DNA, 755 bp, Homo sapiens
  misc_feature: GYAE6OF01CO0S0.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtgctaattttaaaaagtgtcagtgtgaggtgcagctggtggagtcgtgggggagcgttagtacgagtccggtggggggtccctgacgactctcctgcgcacgcctcgtaggtcttcttcctttagttagttatcggccagtcgtacgtttgggcccgccacggccttaccggaggggaacggggtcgtagggacggttgggtctcgaggtcgtaggttgggtgggtaggtcggtcgaccgaggaactacgtaagtttaaccgtaaacgtcccgtagcgacgggtaccgtactttccgtttactccgtaccgaagtaacgtaacctaacgttaccgaaaggtaactacgttaacgtgtaacttctaggactaggttacgaccgtaaggacgtaggtaacgtaggtacggaaaccggtccggtaacggttaccgttaagtttactttaacggtttaggttaaaggtttaaaggtcggggttaaggttggggttaccgtaaccggttaccgggttacccggttggggttaaccccggggggtacccggggtaaaccccgtttgggtaccccgtaacccgtttccgttaacccgg

SEQ ID NO: 170255 - DNA, 492 bp, Homo sapiens
  misc_feature: GYAE6OF01BW1JE.47.77.G11.1.454.CMB.1.raw
  modified_base (477)..(492): a, c, t, g, unknown or other
  misc_feature (477)..(492): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggtatggtggctacgatcgttggggcccgggaacctggtcaccgtctcttcagtccttccaccgaacgggcccatccggttccttcccccgtcggcccgtcccctcgtcctccgacggacgccacccgtcgtgggggccaccgacggcccggcccgtggggcctcggcccgttggtaccgaaacggtaccgttaccttccgtaccggtggacgtccttcgtgacggccgggctggacgtaacgggcgcgagtagnnnnnnnnnnnnnnnn

SEQ ID NO: 170256 - DNA, 670 bp, Homo sapiens
  misc_feature: GYAE6OF01AOUAU.47.77.G11.1.454.CMB.1.raw
  modified_base (426)..(426): a, c, t, g, unknown or other
  misc_feature (426)..(426): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtgaagtcgtgggggaggcttagtacagccgtggggggtccctgagactctcctgcgcagcctctggattctcctttagtagttatgccatgtacttgggtcccgccgaggcctccgaggggaagggctggagtgggtctcgaggctagttggtggtagtggtgccgaggacactattaacgtaaacgtccctggccgacgggtccgtagtttactttacnccttacccgaaggaacgtaacctaacgtttacccgaagggtaaaacctagttacctagtactttccgtagactaagtttcgaacccaggtacctaggacgtacgtcggaaggaccgacggtaccgtaattacttaagttcggttaagtttaaaaggtggggtaagttggggtcggacgttaaccggacgtttccgggttacggggggtacccccggggtaaacccttggggtccctaccccggg

SEQ ID NO: 170257 - DNA, 512 bp, Homo sapiens
  misc_feature: GYAE6OF01DKGXT.47.77.G11.1.454.CMB.1.raw
  modified_base (482)..(482): a, c, t, g, unknown or other
  misc_feature (482)..(482): n is a, c, g, or t
  modified_base (484)..(512): a, c, t, g, unknown or other
  misc_feature (484)..(512): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatggggatggtggctacgactcgttggggccgggaacctgggtcaccgtctcttcagcttccaccaagggcccatcggtcttccccctggccgccctgcctccgaggacgccaccgtcggtcgggggcaccgacggccgggcccgtaggggccttcggccgttgggtacctaaagggtacccttaaccgtttcccgtaacggtcggtacgtccgttcgtaggacgggtccgggtcgttacgggacgaagggccgacaagtacgngnnnnnnnnnnnnnnnnnnnnnnnnnnnnn

SEQ ID NO: 170258 - DNA, 418 bp, Homo sapiens
  misc_feature: GYAE6OF01E4IHK.47.77.G11.1.454.CMB.1.raw
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (405)..(418): a, c, t, g, unknown or other
  misc_feature (405)..(418): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttgggggccgggaaccctgggtccaccgtctctcagcttccaccaggccatcgtctcccctgcncctnctcngncacctcgtggggcacngcggcctgggctgccgtggtcaaggactacttcctacgtgagctctgaggcgggcgtggcgacggcgcagtagnnnnnnnnnnnnnn

SEQ ID NO: 170259 - DNA, 601 bp, Homo sapiens
  misc_feature: GYAE6OF01AR9M5.47.77.G11.1.454.CMB.1.raw
  modified_base (153)..(153): a, c, t, g, unknown or other
  misc_feature (153)..(153): n is a, c, g, or t
  modified_base (155)..(155): a, c, t, g, unknown or other
  misc_feature (155)..(155): n is a, c, g, or t
  modified_base (159)..(160): a, c, t, g, unknown or other
  misc_feature (159)..(160): n is a, c, g, or t
  modified_base (162)..(162): a, c, t, g, unknown or other
  misc_feature (162)..(162): n is a, c, g, or t
  modified_base (164)..(165): a, c, t, g, unknown or other
  misc_feature (164)..(165): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (564)..(601): a, c, t, g, unknown or other
  misc_feature (564)..(601): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccgananactnntntnngtgtacacanagngagtgtacggacgacggccggtacgtattattagttggttaaagttaggaggtgttgggtcgtaccgtacgtcgtttcgggggtccgggggaccccggtacgtcgtaccgtaccgtctttcgtacgctttcctacccaacggggcccggaacctcgggttcccgtttccccccttccgggccgggtccccctccggtacgtcccctacgggaacggccgtaccctcccggttcggggggacggacccacggccgggcccccgtcgggtcgttccggaccgtcggtttaccggaaccggtaaccgtacgtttaccccttacgtggttacttactaccgttcgaagcggggtccgtggcggaaacggcgtccgattaggngctnagcnnnnnnnnnnnnnnnnnnnnnnnnnnnnnnnnnnnnnn

SEQ ID NO: 170260 - DNA, 699 bp, Homo sapiens
  misc_feature: GYAE6OF01B5RFS.47.77.G11.1.454.CMB.1.raw
  modified_base (266)..(266): a, c, t, g, unknown or other
  misc_feature (266)..(266): n is a, c, g, or t
  modified_base (367)..(367): a, c, t, g, unknown or other
  misc_feature (367)..(367): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggtcttaattttaaaaagtgtccagtgtgaggtgcagcgtgggtggagtcgtgggggaggcttagtacagccggtgggggtccctgagactctcctgcgcncgcctctggtacttcttccgtttagtagttactcgcctagtcgacgttcgggtcccgccgacggccgtcggaggggaaggggtcgtgggtaggtcgggtcncgaggctaggttgggtagggtagtggtcgacgacggactacgtaagttaaccgtaaagtccccgtggacgacgggtcccgtattttctttaacgtccgtacccgaaggtaaaccgtaactaacgtttaccgaaaggaacttaacgtacgtacgttatttacgtagtcgtaacgttcgaaccgaagtacgtaggaacgtacggtaccggaagaccgtaccgggacgttaattacgtttagtagttaaggttaaagtgggtagtcgggtggtactacggtacggttcgggtaccggggacccgggttaccgtcggtaccgtccggttctaccgg

SEQ ID NO: 170261 - DNA, 750 bp, Homo sapiens
  misc_feature: GYAE6OF01E12W6.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaaccgagagaactcaccatggagtttgggctgagcgtggtcgtctttacgttgtggtacttttttaaaaaggtgtccagtgtgaggtgcaactgttggagtcgtgggggagacttagtacgacccgtggggggtccctgagactctcctgtgcacgcctctggactcacctttagcaactctagtcgagtcggcgtcgggtcccgccgacgggcggtccgggggaagggcgtgggagtgggtctacgtaagttagttgagtaggaagtaagtgggtacggaaacgtcgtaacgtacgtttccgtaacggtcggaaccgtaccggtacggtaaacgggtcccgtttacacccgtagtcctaccgaagacgtactaacgttacgaggtacgccgtacgtcgttactaactaactaaacgtaaacgtacgaaccgacgtaccggtaggaacggaccggaaccgggtaaccggacccgggttaaaccgggttacccgtttaagtttaccgtttcggtaacggttcggaaacgtaaacggttacctaagtaccgtacgtacccgggtaccccgtaccccgtacggtacccgttccgtttaaccgtttccgtttaacggttccgttcggggtaacccgggg

SEQ ID NO: 170262 - DNA, 192 bp, Homo sapiens
  misc_feature: GYAE6OF01EIELJ.47.77.G11.1.454.CMB.1.raw
  modified_base (171)..(192): a, c, t, g, unknown or other
  misc_feature (171)..(192): n is a, c, g, or t
tcagagctcacgtacacgaccggtgctcgatttagctagtcactcaaagggaaaggggctgagagaggagcccagccctgggattttcaggtgttttcatttggtgatcaggactgaaccgagagaactcaccatggagtttgggctgagcgggctggcaaggcgcatagnnnnnnnnnnnnnnnnnnnnnn

SEQ ID NO: 170263 - DNA, 665 bp, Homo sapiens
  misc_feature: GYAE6OF01C4DV9.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctatttaaaaagtgtccagtgtgaggtgcagctggtggagtcgtgggggaggcttgggtccagccgtggggggtccctcgagactctcctgtcgcagcctcgtggtacttcctaccttttacgttccttctttgggtatagtaagtttcggggtcccgtccctaggacctccggaagggggaacgggggcgtggggaggttggggttgggactaaacgaattaaaatcccgaaggtagtagggaaagttcgaaacggaaaaaccttagtaggtggaacgttctacgtaggacgggccgtaattcgaccacgttcctacgagacgaacaaccgaccaaagtacctctcttcgtttctgtacctaagtcggaactagaccctgacggaagtacggaagtaccgacggtacgtgttagttattacgtgttcgtacgtcttacgcgtacgtccgtcgggcccgtacggtcggtcgttcggcgggtccgtcgggtcccgtcggg

SEQ ID NO: 170264 - DNA, 620 bp, Homo sapiens
  misc_feature: GYAE6OF01AJ63K.47.77.G11.1.454.CMB.1.raw
tcagagctcacgtacacgaccggtgctcgatttagctagtcactcaagggaaagggtagctctgagagaggagcccagccctgggattttcaggtgttttcatttggtgatcaggactgaacagagagaactcaccatggagtttgggctgacctggtctttttcttgtggtctaattttaaaaagtgtccagtgtgaggtgcaggtagtggaggtccgggggaggcttagtcagccgtggggactccctgagactctcctgtgtagtctctggaatcagtttcagttaccttctggatcgctaccgtgggtcccgaccaaaacctcccgaaggggtaacggggtctgggtggtggggttcctcgtaccggtatacgaacttccctgtagtgggctaggttagttaataaatttagcgcggtactccggtgacggggccagttcagcatcctcagtacgacaacggacaagtatatactagtactagtagaaatacgaaactacgtcgtaggagcgtacggacgtagtacggctggtacctattcgtattgttcgtttgattcggtcccgtttcggtcccggtacggtacgttccggcgggtccggtacgggtaacccgg

SEQ ID NO: 170265 - DNA, 905 bp, Homo sapiens
  misc_feature: GYAE6OF01CUE3S.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggtacttaattttaaaaagggtgtccagtgtgaggtgcagcgtggtggagtcgtgggggaggtcttagtacagccgtgggggtccctgagactctcctgccgcagcctcgtggtacttcttccgtttagtagttatcgacctatcgtacgttcggggtcccgccgacgggcctaccggaagggggaacgggggtccgtaggggtagggttcggggtcctcggaacgggtctaaggtttggggtagggttaggtcgggtcgaccgtaagggacctaacgtaacgtttaaaccggttaaacgttccccgtagggacccggtaacggggtacccgttaacttttaccgttttaacttcccgtaacccgaaggtaaccgtaaaccttaaaccgtttaccccgaaaagggtaaaccttaaacgttaaccgttaggttaactttacgttacggtaccgttaaggtttaccgaaaccccgttaggtaaccggttaggtaaacggtaaccgggttacccgggaaagggtaacccggaacccggggttaccctttaaagtttacgttttaaaggttttaacgggttaaacgggttttaaaaaggttggggggtaaaacgtttgggggtttaccgggtaacccgtttaaccgggtacccggtttacccgggggtttacccggggggggaaccccccgggggttaaaccccgtttcgggtaacccccgttccccggtttccgttaccccgg

SEQ ID NO: 170266 - DNA, 763 bp, Homo sapiens
  misc_feature: GYAE6OF01C0MHH.47.77.G11.1.454.CMB.1.raw
  modified_base (268)..(268): a, c, t, g, unknown or other
  misc_feature (268)..(268): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccagtggagtttggctgacctggtctttttctgtggcttaatttaaaaagtgtcagtgtgaggtgcagctggtggagtcggtgggggagtcttagacgagccggttcgggggtccctgacgtacttcgtccgtgccgnacgtcctgtggtactttcttccgtttaagtagttatcgcctagttcgtacgttcgggtcccgccgaacggtccttaccgggaggggaacgggtcgtgggtagggttcggtactcgaggtcttggttagggtggttagtcgggtcgaccgaaggtacaacgtagtttaacgtaacgtccgtaggacgagggtccgttattctttacgcctacgagacgtaactacttacgaaacgtaactaacgtacgtagtacttcgtacgtacgttacggtaccgaaccgtagtaaccggtaggtaaccggtaaggtcccgggaaacggtaacccggtaaccgggttaccgtttaaattacggttttaaggtaggtttaaacggttaaagggttgggtaaacgttcggggttaacgtacccgttaacggtaccgggttacggggttacccgggggacccggttaaccccgtagggttccccgttaaccggttcccgtttaccgg

SEQ ID NO: 170267 - DNA, 795 bp, Homo sapiens
  misc_feature: GYAE6OF01AM5O5.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagcgtggtggagtcgtgggggaggcttagtacgagtccggtcggggggtccctgacgcctctcctgcgcacgcctcgtggtactttccttccgtttagtagttatcgcctagtcggtacgttcggggtcccgccgacggtccgtaccggaagggggaacggggtcgtgggtaggtcgggtctcggaggtctaggtttgggtggttaggtggtcgaccgaggaacctacgtaacgtttaaccggtaaacgtccccgtaggaccgtacgggtccgttaactttccgtttaactcccttaccgaaggtaacgtaacccttaagttacccgaaaggtaaacctagttacgttagtactttccgtagacctaggtttcaaccgtagtacgtaggacggtacggtacggaacgggtacccgtaacgggttaccttaaagttagttttaacggtttaggtttaaagggtttaaaagggttcggggttaagttacggggttcggtaacccgttaaccgggttacccgggtttaccgggggttacccgggggggaaccccccggggtttaaaccgttccggggttaaccccttaccccggg

SEQ ID NO: 170268 - DNA, 519 bp, Homo sapiens
  misc_feature: GYAE6OF01EG5OI.47.77.G11.1.454.CMB.1.raw
  modified_base (311)..(311): a, c, t, g, unknown or other
  misc_feature (311)..(311): n is a, c, g, or t
  modified_base (480)..(482): a, c, t, g, unknown or other
  misc_feature (480)..(482): n is a, c, g, or t
  modified_base (484)..(519): a, c, t, g, unknown or other
  misc_feature (484)..(519): n is a, c, g, or t
tcagagctcacgtacacgaccggtgctcgattttagctagtcactcaagggaaaggggctggagtgggtctcaggcattggtggtagtggtgccaggacacattacgtaaagtccctgcagggccgatttctttatctccagagacaattccaggaacatactgattctgcagttgaccagactgagagtcgaggacacggccgtatattattgtagttaaatgggatggtgctacgctcgtgggggccgggtaacctggtccaccgtctcttcagtccttccacacgggcccatccggtccttcccccgnggcccgccctgcctccgaggacgcctacccgtcggtcgggggcacgacggccggcccgtggggcctcggcccgtaggtccgaaacgggtaccttaccgttccgtacggtcgacgtctcgtcgggacggtccgggtctacgggaccgaacgggtccgacgaacgtaggcnnngnnnnnnnnnnnnnnnnnnnnnnnnnnnnnnnnnnnn

SEQ ID NO: 170269 - DNA, 1000 bp, Homo sapiens
  misc_feature: GYAE6OF01AXFPR.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggaggtttggctgacctggtctttttcttgtggacttaatttaaaagtgtccagtgtgaggtgcagctggtggagtcgtgggggagtcttagtacgagccggtggggggtccctggacgtactctccgtgccgcacgtcctcgtggacttccttcctttaggtagttatcgacctagtcgtacgtttcggggaccccgtcccgtaacgggcccgttacccgggaaggggggtaaacgggggtcgtagggggtaacgggttcgggggttaccgtacggaacggggtccgttaaaggggttttggggggttaaggggttacgggtttacgggggttaccggaccccggaaaacggggggtaaacccctaaacccggttaaaacggtttttaaaaccccgggttaaaaacccgggtttccccccggttaaggggaaccccgggtaaccggggggtaccccggttttaaatttttccccgttttttaaccgtacccgtttaaccccggaaaggtaaaccggtaacccgttaaaccgttttacccccgaaaagggttaaacccttaaacgggttaaaccttaccgggtttaacgtttttacccgtacgggtaaccgtttaacggtttaccgaaacccccgttaaaggttacccgtagggtaaagggtaaccggttacccggggaaaggggtaaccccgtacccggggttaacctttaaagtttacgtttaaggtttagggttaaacgtttaaaggggtaggggttagtacggggttacggttaccgttaccgggttaccggttcggggttacccggggggacccccggggttaaccgttccgggttacccgtaccccgggttcttacccgg

SEQ ID NO: 170270 - DNA, 572 bp, Homo sapiens
  misc_feature: GYAE6OF01DYS1C.47.77.G11.1.454.CMB.1.raw
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(529): a, c, t, g, unknown or other
  misc_feature (527)..(529): n is a, c, g, or t
  modified_base (531)..(531): a, c, t, g, unknown or other
  misc_feature (531)..(531): n is a, c, g, or t
  modified_base (533)..(535): a, c, t, g, unknown or other
  misc_feature (533)..(535): n is a, c, g, or t
  modified_base (537)..(541): a, c, t, g, unknown or other
  misc_feature (537)..(541): n is a, c, g, or t
  modified_base (543)..(544): a, c, t, g, unknown or other
  misc_feature (543)..(544): n is a, c, g, or t
  modified_base (546)..(553): a, c, t, g, unknown or other
  misc_feature (546)..(553): n is a, c, g, or t
  modified_base (555)..(559): a, c, t, g, unknown or other
  misc_feature (555)..(559): n is a, c, g, or t
  modified_base (561)..(562): a, c, t, g, unknown or other
  misc_feature (561)..(562): n is a, c, g, or t
  modified_base (564)..(568): a, c, t, g, unknown or other
  misc_feature (564)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
tcagagctcacgtacacgaccggtgctcgatttagctagtcactcaaagggaaaggggctgggagtgggtctccaggcattggtggtagtggtgccaggacacattacgtaaagtccctgcagggccgattctttatctccagagacaattccaggaacatactgattctgcagttgaccagactgagagtcgaggacacggccgtatattattgtagttaaangggatggtggctacgactcgttggggcccgggaacctggcaccgtntcttcagccttccaccgaacgggcccagtcccggtcctttccccccgtggccgtcccctggccgtccgagggacgccgaccgttcggtcgggggccacgaacggccgggtccccgtaggggctcggccggttcggtacgaaacgggtaccttaccgtttacccgtaaccggttcggaacgtccgttacgtacgggacggtcggggccgttacgggaccgtaacgggccgacgtaacgtaagcgagnacgcncngngnnngngnnngnnnnngnncnnnnnnnngnnnnngnngnnnnngngn

SEQ ID NO: 170271 - DNA, 592 bp, Homo sapiens
  misc_feature: GYAE6OF01BKCSU.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggagcttagtacagccgtggggggtccctgagactcctcctgcgcagcctctggattctcctttagtagttatgccatgacgttgggtcccgccaggcctccgaggggaaggggcgtgggtaggtgggtctcgaggctagttgggtggtagtggtgccgaggacacgattacgtaaacgtccctgcgagggccgtattctttatcctccgagacgaactaattccgaaggaacatctagtattctgctagtcgaccagtctagagagtcggaggacgacgtaccgtatattagttgtagttaaagtgggtagtgggtagtcgtacggaccgttcggttcgggggacccggggtaccctgggtccgtaccgtcgttccg

SEQ ID NO: 170272 - DNA, 859 bp, Homo sapiens
  misc_feature: GYAE6OF01AEDR3.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctattttaaaaagtgtccagtgtgaggtgcagctggtgggaggtccgggggaggcgttagtacagccgtcggggggtcctgagactctcctgcgcacgcctctggattcctcctttagtagttatgccagtgtacgttgggtcccgccacggcctccgaggggaaggggcgtagggaggtcgggtctcgaggtctaggtttgggtggttaggttacgggtcgtcccgaagggtaaccacgtaacgtttaaaccggtaaaacgttccccgtaggtaccggtaacggggtccccgtaagttttcccttttaacgtcccgttaaccccgaaggtaacggtaacctaaacgtttaccccgaaagggtaaacctagttaaacccgttgttaaacgtttcccgtaggaccttaaggtttccggaaaccctaagggttacccgtagggaaaccggtaacggttaccgggaacgggtaacccgaaccggggttaacccggttaactttaacgttttaacggtttcgggtttaaaacggtttaaaacgggttcggggggtaaagtttacggggggttaccgggtacccttttaacccgggaaccggttttacccgggggttttaccgggggggggaaacccccccggggtttaaaccccggtttcggggtttcccccgtaacccccgggtttacccg

SEQ ID NO: 170273 - DNA, 865 bp, Homo sapiens
  misc_feature: GYAE6OF01CJRIB.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcacatggagtttgggctgaccgtgtctttttcttgtggtcttaattttaaaaagtgtccagtgtgaggtgcagcgtggtggagtcgtgggggagtcgttagtacgacggtccggttcggggggtccctaggacgtacctctcccgtgccgacacgccttcgtggtacttcttacgtttaagtagttatgacctagttcggtaccgtttcggggtccccgaccgaggccctaccgggaagggtaacgggggtcgtagggagggtacgggtctacgaggtactaggttgggtaggtaggttggtagcccggaaggtaccaacgttaacggtttaacgtaaaacggttccccgaggtaaccggtacggggtaccccgttaattttaccgtttttaaccgtaccgttacccggtaaacgtaacggtaaactttaaacccgttaaccgaaaacgggtaaaactaacgttaacccgtaggttaccttaccggtagtaaccggttaacggttacgaaaccccggaagtaaccggttacgggacggttaaacggtaccgggtaaacgggaaccggtaacccgggtaccgtttaaaagttatttaagtttaaggtttaacggtttaaaagggtaggggtacggtttagggcgggttaacccgttacgggttaaccggttccggggtttaacccgggggggaacccccggggttacccggttcgggttacccggttaccccgg

SEQ ID NO: 170274 - DNA, 674 bp, Homo sapiens
  misc_feature: GYAE6OF01CMWO6.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttctgtggcttattttaaaaagtgtccagtgtgaggtgcagctggtggagtcgtgggggaggcttagtacaggccgtggggggtccctgagactctcctgcgcagcctctggattctcctttagtagttatgccatgacgttcgggtcccgccgaggctccgaggggaaggggcgtgggagtgggtctcgaggctagttggtggtaggtggtgaccgaggacacgtaagttaacgtaaacgtccctggcgacgggtacctatttctttaactcctaccaaggaactactaaacgtttccgaaggtaactacttacgtagtacttcgtgacgtagttacgaacccagtacgtaggagtacggtcggaacggaccgtaccgggtaccgtaatttacgttagttaggttaacggttaaaggttcggggtagttaggggttcggtaccgtaacggttaccgttacggggttaccggggggaccccgggtaacccggttgggtacccgttaccccgg

SEQ ID NO: 170275 - DNA, 868 bp, Homo sapiens
  misc_feature: GYAE6OF01CPXHO.47.77.G11.1.454.CMB.1.raw
tcagagctcacgtacacgaccggtgctcgatttagctagtcactcaagggaaaggggagctctgagagaggagcccagccctgggattttcaggttgttttctatttggtgatcaggactagaacagagagaactcaccagtggtagtttggctgacctggtctttttcttgtggtcttaatttaaaagtgtccagtgtgaggtgcgagcgtgggtggtagtcggtgggggaggtacttaggtacgacggcccggttcggggggtccctggacgtacctcctccgtcggcgaccgacgtccgttcgtaggttacctttctttacccgttttaaggttagttaactcggtacctagttacggtacggtttccgggtccccgccgtacggtccgtaccgggaaggggtaacggggtcgtggggtaggtcgggttccgtagacggtcgttagggttgggttggttaggtcgggtcgcccggtaaggacgtaacgttaacgttaaaccggttaaacgtccccgtaggtaccggtacgggtaccgttacttttccgtttaacctccgttaccgaacggtaacgaaaccttaaacgtttaaccgaacggttaaactacttaacgttagtacttcgtacgtaacgtacgtacgaaccgtagtaacggtagtacggtacgggtacggaaaccggtaccggtaaccgggttacgttaagttacgttttaagttacgggtttaaaggttaaagggttacggggttagggttacgggttcgggtaaacccggtttaaccggtaacgggtttccccgggggtttaacccggggggaccccggggtttaaaccccggtccggggtttaacccgttaccccg

SEQ ID NO: 170276 - DNA, 469 bp, Homo sapiens
  misc_feature: GYAE6OF01DGTO0.47.77.G11.1.454.CMB.1.raw
  modified_base (336)..(336): a, c, t, g, unknown or other
  misc_feature (336)..(336): n is a, c, g, or t
  modified_base (444)..(444): a, c, t, g, unknown or other
  misc_feature (444)..(444): n is a, c, g, or t
  modified_base (452)..(469): a, c, t, g, unknown or other
  misc_feature (452)..(469): n is a, c, g, or t
tcagagctcacgtacacgaccggtgctcgatttagctagtcactcaaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtgctacgacttcgttggggccggggaaccctggtccaccgtctcttcagtcctccaccaacgggcccatcggtccttcccccgtggccgccctgccgtccagggacnccaccgtcggtgggggcacgaggccgggccctgggcctgccgtggtacaaacgggtacctaccgttcctacgttgacgtctcgtggacggcgggctgggacagggcgngaagtagnnnnnnnnnnnnnnnnnn

SEQ ID NO: 170277 - DNA, 451 bp, Homo sapiens
  misc_feature: GYAE6OF01EISDR.47.77.G11.1.454.CMB.1.raw
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (368)..(368): a, c, t, g, unknown or other
  misc_feature (368)..(368): n is a, c, g, or t
  modified_base (413)..(451): a, c, t, g, unknown or other
  misc_feature (413)..(451): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtaatattattgtagttaaaatggggatggtggctacggacttcgttgggggccgggaacctggtccacgtctctcagctcacaggccatcggtctccccgngcncctgctcagncacctcgngggcacgngcgcctggctgcgtggacaagactactcctacgtgngctcgtggacggcgggtcgtgggacgtaacggcgacagtacggannnnnnnnnnnnnnnnnnnnnnnnnnnnnnnnnnnnnnn

SEQ ID NO: 170278 - DNA, 867 bp, Homo sapiens
  misc_feature: GYAE6OF01CY671.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttggctgacctggtctttttcttgtggacttaattttaaaagtgtccagtgtgaggtgcagcgtggtggagtcgtgggggagtcttagtacgaggtccggtgggggtccctaggacgtaccttccgtccgtggccgcacgtcccttcgtacggttacttttccgtttaccgtttttaaggttacgtttacgtcgtacctaagttcggtaccggtttcggggtccccgaccgtaggtccgtaccgggaagggggtaacggggtcgttaggggtacggttcgggtcctacggaggtacgttaggttgggttaggttacggttcgggtcggaccgaaggtaactaacgttaacgttaacggtaaacgtcccgtaggaccggacgggttccttacttttaccttaacgtccgtaaccgtaaggtaacgtaaccttaaccgtttacccggaaacggtaaaccttacgtttaaccgtaggtttaccgtttccgtaacggtaccgtttaacggttaacccggaaaccgttaggacccggttaagggaacggttaccgggtacgggaaacggtacccggtaaccggttaccttaaagtttacgtttaggttaaggtttaaggtaaaacgggtgggttaagttcggggtacgtaaccccgtttaggtacccggtttacccgggggtaccgggggtaacccccgggttaaccgttgggtaccccggttaacccg

SEQ ID NO: 170279 - DNA, 734 bp, Homo sapiens
  misc_feature: GYAE6OF01C8WRK.47.77.G11.1.454.CMB.1.raw
  modified_base (276)..(276): a, c, t, g, unknown or other
  misc_feature (276)..(276): n is a, c, g, or t
tcagagctcacgtacacgaccggtgctcgatttagctagtcactcaaagggaaaggggagctctgagagaggagcccagccctgggattttcaggttgttttcattttggtgatcaggactgaacagagagaactcaccagtggagtttgggctgacctggtctttttcttgtggtacttaattttaaaaagtgtcctagtgtgaggtgcagcgtggtggaggtcggtgggggagcttagtacaggccggtgggggtccctagacgacctctccgngccgcagtcctcgtaggtacttccgttaccgtttaagtagttatcggtacctagtcgtaccgtttcgggtaccccgaccgacggtccgtaccggaagggggaacggggctagggtaggtcgggtctacgaggtacgtaggttgggtagggttacggtggtcgaccgaggtactaaactacgttaacgtaaacgtcccgtagacgtagggccttattcttactccaccgaagtacgaactaacgttcgaaacggtaacattacgtacgtattcgagtacgtagttaccgaaccgtaagtacaggtaacggagtaccggaacggaaccggtaccggttacgttaattaacgtttagtaaggtttaaggttaaaggtcgggttaggttcgggttacgaccgttacggtaccggttcggggttaacccggggaccgggtaaccccgtggttacccgtacccg

SEQ ID NO: 170280 - DNA, 575 bp, Homo sapiens
  misc_feature: GYAE6OF01A0UN4.47.77.G11.1.454.CMB.1.raw
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
  modified_base (549)..(549): a, c, t, g, unknown or other
  misc_feature (549)..(549): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
tcagagctcacgtacacgaccggtgctcgatttagctagtcactcaagggaaagggctggagtgggtctcaggcattggtggtagtggtgccaggacacattacgtaaagtccctgcagggccgattctttatctcagagacaattccaggaacatactgattctgcagttgaccagactgagagtcgaggacacggccgtatattattgtagttaaatgggatggtggctacgactcgttcgggggccgggaaccctggtccaccgttctcttcgagtccttaccaccaacgggccctagtcggtccttccccgnggccnccctgcctccgaggacnccacctcggtgggccacgagccggcctagggctcgccgtacggtacgaaggtctacttcgtatacgtaacttacgtcgtacggacggtccgggtcgtacgggtacgaacgggtaccgtacgtaacgttaacggctacgacgtnagtangcgacncgngcgngacganagacgtgtcgngtcgagtctcgagcgcgcgtacgacgacgacgngacgtcagcgacgcncacnctctgcg

SEQ ID NO: 170281 - DNA, 644 bp, Homo sapiens
  misc_feature: GYAE6OF01B4ULF.47.77.G11.1.454.CMB.1.raw
  modified_base (218)..(218): a, c, t, g, unknown or other
  misc_feature (218)..(218): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
tcagagctcacgtacacgaccggtgctcgatttagctagtcactcaagggaaaggggagctctgagagaggagcccagcccctgggattttcaggtgttttcatttggtgatcaggactgaacagagagaactcaccatggagtttgggctgacctggtctttttctgtggcttaattttaaaaagtgtccagtgtgaggtgcagctggtggagtcgngggggagtcgttagtacgaggtccggtgggggtccctggagtacctcctccgtgtcgcacgtcctcgtcggacctctacctttacgctaactctagttcagtggcgtcggtccgcgaggccggtaccggggagggtcgtgggaggttcggtactacgtaagttagttgagttagaaggtaagtgggtagacgcacgtattcgtaggtcgtaccgtcggtacggacgggtcctacacctagtcctaccgagacgtacttaagttcgagacncgaccgtntactactactaacaagtacgaacgcgtacgaggacgtacgaccgagaccgacggtacttacgttgttcgtagtaacgacgttaaagttcgtagtaccgtacccgacggttccccgaccccgtacgcccgttacccgtagttttcccgg

SEQ ID NO: 170282 - DNA, 815 bp, Homo sapiens
  misc_feature: GYAE6OF01BV3VT.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaacgtggttggagtcgtgggggatacgttagtacgacccggtcggggggtccctggacgacttccgtcctggtcgcacgtcctcgtggtacctcctaacctttagacctaaccttctgtcctagtcggggtccgtcggggtcccgccggaacggggtcccgggtaccggggggtaaggggtccgtggggtacggttcggggtacctacgtaaggttacgttgagttaggaagtaacggtgggtaggaacgtctaacgtacgtttaccgtaccggtacggtaccgttccggtacgggaacggggttcccgttaccgacccgtactaccgtaccgtaacggtacgtaaccgttaacgtttaccggaacgggtacggaccgtaaccggtacgttacggttaactacctaaaacgtaaccgtaacggtaaacctccggaccgtaaggaacgggtaccgggaaccggtaacgggtaacccggtaaccgggtaccgtttaacgttaacgtttacggtacggttacggtaaacggttaaacgtacgttaagtaaccggcgtaccggttacccgaccccccgttcggacccgttacttaccctttccggttacgttacccggg

SEQ ID NO: 170283 - DNA, 837 bp, Homo sapiens
  misc_feature: GYAE6OF01CF1KH.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttggctgacctggtctttttcttgtggtcttaattttaaaagtgtccaagtgtgaggtgcgagcgtgggtggaggtcggtgggggaggtcgtttaagtaccgaggtcccggtcggggggtccctaggacgtccttctccgtggccgtcacgtcctcgttcggtactttccgttaccgttttaggttagttacgtcgacctagtcggtaccggtttcggggtaccccgccggtaacgggtcccgtaccggaagggggtacggggtcgtgggtaagggtcgggttctccgtaggcgttaaggtttggggtaggggttacggtgggtaccggaccgtaaggtaacctaactaacgtttaaaccgtaaacgtccccgtaggtaccggtacggggtcccgttaagttttaccgtttactcccgtaccgaaggtaacgtaaccgtaaaccgttaccgaaaccggtaaactaacgttaacctgttaacttccggtcgtacgttacggtaaccgaacctaggtaacgtagggaacgtacgggttaccggaacggtaacccgtacgggtaaccgtttaactttagttaggtttacgttaaaggttacgtgggtacgttagggtcgtaccgttaaccgggtaccggtttaccggggtacccggggggaaccccggttaccccggtcggtaccccgttacccggg

SEQ ID NO: 170284 - DNA, 628 bp, Homo sapiens
  misc_feature: GYAE6OF01AXLT3.47.77.G11.1.454.CMB.1.raw
  modified_base (135)..(135): a, c, t, g, unknown or other
  misc_feature (135)..(135): n is a, c, g, or t
  modified_base (168)..(168): a, c, t, g, unknown or other
  misc_feature (168)..(168): n is a, c, g, or t
  modified_base (186)..(186): a, c, t, g, unknown or other
  misc_feature (186)..(186): n is a, c, g, or t
  modified_base (588)..(592): a, c, t, g, unknown or other
  misc_feature (588)..(592): n is a, c, g, or t
  modified_base (594)..(600): a, c, t, g, unknown or other
  misc_feature (594)..(600): n is a, c, g, or t
  modified_base (602)..(628): a, c, t, g, unknown or other
  misc_feature (602)..(628): n is a, c, g, or t
tcagagctcacgtacacgaccggtgctcgatttagctagtcactcaagggaaaggggctggagtgggtctcaggcattggtggtagtggtgccaggacacattaacgtaaagtccctgcagggccgattctttanctccagagacaattccaggaacatactgattcngcagttgaccagactganagtcgaggacacgccgtatattatgtagttaaatgggatggtgactacgactcgttgggggcccgggaacctggtcaccgtctcttcagtccttaccaccgaaagggcccctaagtccggttaccttccccccgtggcccgccccgttgccttcccgaagggaccgtaccccgtaacccgttccgggtacgggggggcccctaacggaaccgggtcccggggtaacccccgtttgggggacccttcgggtaccccggttacgggtttaaccgaaaacggggtacccttaacccgtttacccgttaacggtacggtaacgtcccgtttacgagggtaacccgggtccgggttaccgtacggaaccgaacggggtccgtaccgtaagaacgtgaccaaggcacnnnnncnnnnnnnannnnnnnnnnnnnnnnnnnnnnnnnnn

SEQ ID NO: 170285 - DNA, 545 bp, Homo sapiens
  misc_feature: GYAE6OF01CMZ8I.47.77.G11.1.454.CMB.1.raw
  modified_base (482)..(482): a, c, t, g, unknown or other
  misc_feature (482)..(482): n is a, c, g, or t
  modified_base (526)..(545): a, c, t, g, unknown or other
  misc_feature (526)..(545): n is a, c, g, or t
tcagagctcacgtacacgaccggtgctcgatttagctagtcactccagggaaggggctggagtgggtctcaggcattgggtggtagtggtgccaggacacattacgtaaagtccctgcagggccgattctttatctcagagacaattccaggaacatactgattctgcagttgaaccagactgagagtcgaggacacggccgtatattattgtagtaaatgggatggtggctacgacgtcggttcgggggcccggggtaaccctggtcctaccgtcttcttccaagtccttacccaaccgtaaacggggcccctaagttccgggttccttccccccgtgggcccgcccctggcctaccgaggacgtccaaccgtcggtgggggccaacgacggtcccgggcccctgggggtcctggcccggttcggtaccgaaaaggggtacccttaacctttacccgtacgggttggaacgtctttaccgnggaacggtccggggctacggggacaaggggccgtacaaagtcgnnnnnnnnnnnnnnnnnnnn

SEQ ID NO: 170286 - DNA, 516 bp, Homo sapiens
  misc_feature: GYAE6OF01ERY3A.47.77.G11.1.454.CMB.1.raw
  modified_base (496)..(516): a, c, t, g, unknown or other
  misc_feature (496)..(516): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggtatggtggctacgacttcgttcgggggccgggaacctggtccaccgttctcttcgagtccttacccaccgaacgggccctagttccggttcccctttccccccgtagggccccgtaccccgtcggtccgtccgaacgggtacgccgtacccgtcggtcgggggccacgtcggtcggcccgtgggtctcgccgtaggtacgaacggtaccttaccttccgtaacgtacgtctcgtgggacggtcgggtcgtacgggacgaacgggcgacagtgnnnnnnnnnnnnnnnnnnnnn

SEQ ID NO: 170287 - DNA, 515 bp, Homo sapiens
  misc_feature: GYAE6OF01EP0NN.47.77.G11.1.454.CMB.1.raw
  modified_base (443)..(443): a, c, t, g, unknown or other
  misc_feature (443)..(443): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (480)..(515): a, c, t, g, unknown or other
  misc_feature (480)..(515): n is a, c, g, or t
tcagagctcacgtacacgaccggtgctcgatttagctagtcactcaaagggaaagggggctggagtggggtctcaggcatttggtggtagtggtgccaggacacattacgtaaagtccctgcagggccgattctttatctccagagacaattccaggaacatactgattctgcagttgaccagactgagagtgaggacacggccgtattattagttgtagtttaaagtggggatgggtggctaacgacttcggttcgggggccggggtacctggtccaccgtctcgttcagtccttaccaccgacgggcccacgttccggttccttcccccgtggccccgtccccgtgcctccgacgggtaccgccgtacccgtcggtcggggcacgcggccggccgtgggctcgccgtggacacggtactccttccgtacgtcgcgtctcgngacggcggcgtaggacgaaggcgactatagntnacgnnnnnnnnnnnnnnnnnnnnnnnnnnnnnnnnnnnn

SEQ ID NO: 170288 - DNA, 793 bp, Homo sapiens
  misc_feature: GYAE6OF01BF62R.47.77.G11.1.454.CMB.1.raw
tcagagctcacgtacacgaccggtgctcgatttagctagtcactcaagggaaagggctgagagaggagcccagccctgggattttcaggtgttttcatttggtgatcaggactgaacagagagaactcaccatggagtttggctgacctggtctttttcttgtggtacttaagtttaaaagtgtccagtgtgaggtgcagtcgtggtggagtcggtggggaggtcttagtacgacggtccggttcgggggtccctggaacgtcctccgtccgtcgcgcgacgtccttcgtaggtacttccgttaccgttttaagtagttacgtcgtacctagtcggtcgttccgggtcccgtacgacggtccgtaccggaggggaacgggtcgtggtaggttcggtcgtaggacggcgttaggttgggtaggttacggtggtcgtaccggacggtaactaacgtaagtttaaccggtaaacgttccgtacgacgtacggtaccttagtttactttacgtccgttaacgacgtaataaccgtactaacgaacgtaactaagtacgtagtacttacgtcgtacgtactaccgaaccgtaagtagtcggtaacgtaggtaccggtaacgtaccggtacggttaacgttaagtttacgtttaacggttaggttaaggttaacgggtagggttaggttacggttaccgtacggttacgggtaaaccccgggtttccggggtacccgggggttaaccccggggttaccggtttaccgggtaaccccgttcccgtttaaccggttccccg

SEQ ID NO: 170289 - DNA, 484 bp, Homo sapiens
  misc_feature: GYAE6OF01EN855.47.77.G11.1.454.CMB.1.raw
  modified_base (458)..(484): a, c, t, g, unknown or other
  misc_feature (458)..(484): n is a, c, g, or t
tcagagctcacgtacacgaccggtgctcgatttagctagtcactcaaaggggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccttaatattattgtagttaaagtgggatggtgctacgactcggttgggggccgggaacctggtccaccgtctcttcagcttccacaggcccatcggtccttccccgtggccgccctgcctccgaggcgcacctcggtcgggggcacgcggccggcccgtgggctcgccgtagggtaccaagggtaccttacttccgtacggtagacgtcctcgtgacgggtccgggcgtacgggacgaagggtccgacagtaggcnnnnnnnnnnnnnnnnnnnnnnnnnnn

SEQ ID NO: 170290 - DNA, 786 bp, Homo sapiens
  misc_feature: GYAE6OF01CIXMR.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttctgtggcttaatttaaaagtgtccagtgtgaggtgcagctggtggagtcggtgggggagtcttaagtacgaggtcccggtcggggggttccctaggacgaccttctccgtggcgcgacgccttcgtggtaactttccgttacctttaggttacgtttactcggacctaagttcggtaaccgtttcggggtccccgtccgtaacgggtcccttacccggaagggggaacggggtccgttagggacgggttcgggtactcgaggtacgtaggtttcgggtggtacggtcgggtcgtaccgaaggaactacgtaagttaacgtaaacgtcccgtagaccggacgggtccgtatttcgtttaactccgttaccgaggtaacgtaacctaaacgttccgaaacggtaaactacgttaacgttcggttaacttcgtcgtaccgtaaggttccgaaccgagtacgttaaggacggttaacgtccggaaacgggtaccctaacggggtccttaaagttacgtttagttacgttaaggttaaaacggtcgggtaaggttcgggttagaccgttaacgtccggttacgggttccggggggaacccccggttactcgggttccgtaaccccgg

SEQ ID NO: 170291 - DNA, 913 bp, Homo sapiens
  misc_feature: GYAE6OF01BYJYI.47.77.G11.1.454.CMB.1.raw
tcagagctcacgtacacgaccggtgctcgatttagctagtcactcaagggaaaggggagctctgagagaggagcccagccctgggtattttcaggttgttttctatttggtgatcaggactgaacagagagaactcaccagtggtagtttgggctgtaccttggttctttttcttggtggtactttaaagttttaaaaagtgtaccgtagtgtgaggtgcagcgtgggtggtaggtcgggtggggtacgtcgttaggtacgtacggtcccgggttcggggggtccctggacgtaccgttcctcgtcggccgcgtacgtccgtcgtcggttaactttccgtttaccgtttagttagttacgttcgtacctagttcggttaccggttcgggtcccgacggacggtccgtacgggaacgggggtagggtccggtgggtacgggtcgggttacgtcggtacggtacttagggtttacgggtagggttacggtcgggtacgacccggtaaggtaaccgtaacgttaaagttaacccggttaaaccgtcccgtacggtaccggtaacgggtaccgtttacgtttacctttaccgtcccgttaaccgaaggtaacgtaaaccttaaacgttacccgaaagtaaacccttagttaacgttagttaccgttcgtacgttaacgttacggttaccgaacccgtaaggtccggtaagggaccggttacggtaacgggaacggtaaccccggtaacgggtttacttaaactttaaggttttacggtttaagggttaaacggtttaaagggttcgggtaaggtttacggggtacccgggttaaccgtttaccgggttaaccgggtttacccggggggtacgggtaaccccccgggggtactttacccggtccccgggtttaacccg

SEQ ID NO: 170292 - DNA, 897 bp, Homo sapiens
  misc_feature: GYAE6OF01AKZLE.47.77.G11.1.454.CMB.1.raw
  modified_base (243)..(243): a, c, t, g, unknown or other
  misc_feature (243)..(243): n is a, c, g, or t
  modified_base (646)..(646): a, c, t, g, unknown or other
  misc_feature (646)..(646): n is a, c, g, or t
  modified_base (670)..(670): a, c, t, g, unknown or other
  misc_feature (670)..(670): n is a, c, g, or t
  modified_base (796)..(796): a, c, t, g, unknown or other
  misc_feature (796)..(796): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggcttattttaaaagtgtccagtgtgaggtgcagctggtgagtcgtggggagcttagtacaggtccgtgggggtcccngacgactctctgcgcacgtcctcgtaggtacttccgttaccgttttaggttagtttacgtcggtaccctagttcggtaaccgttttccgggggtaccccgaccccgtacgggtccgttacccgggaaggggggtaaaccggggtccggttagggggtaacggggtttcgggttaccgttccggaaccggggtccgttaagggttttcgggggtttagggttaacgggttggggttaccggaccccgtaaaggggaacctaaaccgttaaaccggttttaaaccggtaaacccggttcccccgtaggggacccggtaaacggggttaccctttacgtttttacctttaccgtcccgttaccggaacgaacgtaaccgtaaactttacccggaaggtaaaccctnttaaccgttaggttcttttaccgngtaccggtagtttacccgaaaccttagaccgttaaggccggtaacgggttacccggaaagggtaaccccggtacccgggtaacgtttaatttacgttttaacgttaggttaacgtttaaaaccggnggggttaacgtttcggggacgttaacccggtcgttaaccggttcggggttacccgggggtaacccccggttactcggggtaaccctccgtttcgttacccg

SEQ ID NO: 170293 - DNA, 826 bp, Homo sapiens
  misc_feature: GYAE6OF01CNFF7.47.77.G11.1.454.CMB.1.raw
tcagagctcacgtacacgaccggtgctcgatttagctagtcactcaagggaaaggggagctctgagagaggagcccagccctgggattttcaggtgttttcattttggtgatcaggactgaacagagagaactcaccatggagtttggctgacctggtcttttctgtggtacttaattttaaaagtgtcctagtggtgaggtgcgagtcgtgggtcggagtcggtgggggaggtcgttaaggtaccgaggtccggttccggggggtccccgagtacctctcctggccgcgacgcctcgtacggtacttccttaccttttaaggtcttatcgtacctagtgtaccgttcgggcccgtccggacggtacccgttaccgggaaagggggtaacggggtccgtaggggtacggttccgggggtacctcgggaacgggtcgtaaggtttggggtagttacgggttcggtcggtaccgaacgggaaccgtaaaccgtaagtttaaacccggtaaacgtcccctagggaccgtacggtccttacgtttcctttacgccgttaccgaggtaacgtaacgtacttaacccggaaagtaacctaagttaccgtagtacgtttacgtcgtaacggtacgttaccgaacgtacggtaacgtgtaaagggtccgtaccgggtaggaacccgttacggtaacccggttatttaaaggttagtttacggttaaaaggttaacgggtagggttacgttaggggtacgttccggtaacgtacccggtttccggggtaccgggggtacccgggttaacccgtcgggttcccgttaccggttccc

SEQ ID NO: 170294 - DNA, 706 bp, Homo sapiens
  misc_feature: GYAE6OF01ETCR8.47.77.G11.1.454.CMB.1.raw
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (625)..(625): a, c, t, g, unknown or other
  misc_feature (625)..(625): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
  modified_base (649)..(649): a, c, t, g, unknown or other
  misc_feature (649)..(649): n is a, c, g, or t
  modified_base (664)..(664): a, c, t, g, unknown or other
  misc_feature (664)..(664): n is a, c, g, or t
  modified_base (670)..(670): a, c, t, g, unknown or other
  misc_feature (670)..(670): n is a, c, g, or t
tcagagctcacgtacacgaccggtgctcgattttagctagtcactcaagggaaggggctggagtgggtctcaggcattggtggtagtggtgccaggacacattacgtaaagtccctgcagggccgatttctttatctccagagacaattccaggaacatactgattctgcagttgactagactgagtagtcggagacgacgggccttagttatttattggttagttaaagtgggattcgggtaggtctaacgaccgttcggttaccggggggaccgggtaaccctgggttacctaccgttctcgtttaccgatccgttaccaaccgaacgggtccctacgttccggttccccttacccccgtggccccgtcccgttacggcccgttaccgaaacgggtcctacccgtaacccgggtccggttacgggggacaccgggtaccgggccccggtacccggttcggggcttaccggtccgttacgggaccgttaaacgggacccttttaccgttacccggtttaggaaccgaacgttctttaccggacggacggggtccggttaccgggagggtaccgtacgggccgaacgttaacggcggtatcggataacggngtancttcgcagtncgcgacngntgacagacgtcgtanagtacgtacgcacgngagtanacgacgtagtagtgacgtgacgcactatactctagc

SEQ ID NO: 170295 - DNA, 626 bp, Homo sapiens
  misc_feature: GYAE6OF01C83GS.47.77.G11.1.454.CMB.1.raw
  modified_base (171)..(171): a, c, t, g, unknown or other
  misc_feature (171)..(171): n is a, c, g, or t
  modified_base (216)..(216): a, c, t, g, unknown or other
  misc_feature (216)..(216): n is a, c, g, or t
  modified_base (274)..(274): a, c, t, g, unknown or other
  misc_feature (274)..(274): n is a, c, g, or t
  modified_base (566)..(566): a, c, t, g, unknown or other
  misc_feature (566)..(566): n is a, c, g, or t
  modified_base (568)..(570): a, c, t, g, unknown or other
  misc_feature (568)..(570): n is a, c, g, or t
  modified_base (573)..(573): a, c, t, g, unknown or other
  misc_feature (573)..(573): n is a, c, g, or t
  modified_base (575)..(576): a, c, t, g, unknown or other
  misc_feature (575)..(576): n is a, c, g, or t
  modified_base (584)..(585): a, c, t, g, unknown or other
  misc_feature (584)..(585): n is a, c, g, or t
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (619)..(620): a, c, t, g, unknown or other
  misc_feature (619)..(620): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagagctcacgtacacgaccggtgctcgatttagctagtcactccagggaaggggctggagtgggtctcaggcattggtggtagtggtgccaggacacattacgtaaagtccctgcagggccattctttatctccagagacattccaggaacatactgattctgcagttnaccagactgagacgtcgagacgcggcgtatatatgttattaaagngggatggtgactacggtacgtcgttcgggggcccgggtaaccctggtcctaccggttnttacctttcgacgtccttacccaaccggtaacgggtcccagtttcccggtaccctttcccccgcgggcccctacccgttggtacccttacgacggacgacccgtaccgttcggtacggggcctaaaccgcgggtccccggcccgttgggggcccttcggacccggtttggtaaccccgtaaaacggggttaccttaacccggttccccgtttaagcggtaaccgtccttcggttacgggacggcggggtcctagggacgaaacgtcggaacctagtaggcacgcgtacagcncnnngcngnnctcgcgannagnnangnangnngagcgnncncncngacgcacnnctgngn

SEQ ID NO: 170296 - DNA, 725 bp, Homo sapiens
  misc_feature: GYAE6OF01ENXMI.47.77.G11.1.454.CMB.1.raw
  modified_base (248)..(248): a, c, t, g, unknown or other
  misc_feature (248)..(248): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttctgtggtacttaatttaaaagtgtccagtgtgagtgcagctggtggagtcgtggggagtcttagacgagccggtgggggtcccngacgtacctctccgtgcgcacgcctcgtaggtactttccttaccgttttaaggttacgttatcgtacctaagttcggtacgtttcggggtcccgaccgtacgggtcccgttaccgggagggggtaacggggtcggtgggtaacggttgggtccgtacgaggtactaggttcgggtggtaggttggcgacgacggtaacacgtaacgttaacgtaacgtccccgtaggccgacggggtccttacttttacgtttactaccgtaccgtaagtaccgtaacttaaacgttaccgaaacggtaaccttaacgtacgttagtacttacgtcggtaacgttaggttaccaaccgtagtaccgtaggaacggtgtacggacgacggtacggtaccttaagtactttagttggttaagttaaggtgggtatgggcttacaacggttcgtcgggttaccggggacccggtcgtcggtccgtacccg

SEQ ID NO: 170297 - DNA, 704 bp, Homo sapiens
  misc_feature: GYAE6OF01B1DXJ.47.77.G11.1.454.CMB.1.raw
  modified_base (612)..(612): a, c, t, g, unknown or other
  misc_feature (612)..(612): n is a, c, g, or t
tcagagctcacgtacacgaccggtgctcgatttagctagtcactcaagggaaaggggctgagagaggagcccagccctgggattttcaggtgtttcatttggtgatcaggactgaacagagagactcaccatggagtttgggctgacctgtcttttcttgtgtcttaatttaaaagtgtctagtgtgaggtgcgagtcgtgggtggtaggtcggtggggggacgtcgtttagtacgacgtcccggttacggggggtccctggaacggtacctcccgtccgtagccgaccgtacgccttcgtcggtactttccgtttaccgtttagttagttactgtacctagttcggtacggttcgggtccccgacgacggccgtacgggaggggacgggtgtagggaggttcggtctacggacggtcgtaggttcgggtaggtaggtcggacgcgaacggactaccgtaagtttaaccggtacgttcgtgaccggtacgggtacttacgtttacttactccgtacacgtactacgtaacttacgaaacgtaacgtactacgtctattcgagtactagtactacgtagacgtacgtagaggtcggacgtaacgcgtacgttntagtttacgtaggttacgttaggtggtaggtgtacgtacgtacggtcggttcggggtaccgggtccggtacgtccgtcgtccgtcgttaccg

SEQ ID NO: 170298 - DNA, 813 bp, Homo sapiens
  misc_feature: GYAE6OF01A6M6W.47.77.G11.1.454.CMB.1.raw
tcagagctcacgtacacgaccggtgctcgatttagctagtcactcaagggaaaggggagctctgagagaggagcccagcccctgggattttcgaggtgttttcatttggtgatcaggactgaacagagagaactcaccatggagtttgggctgacctggtctttttctgtgcttaattttaaaagtgtccagtgtgaggtgcagcgtgggtggagtcggtgggggagtcgttagacgacggccggtcgggggtccctgagcctctccgtgccgcgacgtcctacgtggtactttccttcccgttttaagttagtttatcgaccctagttcgtaaccggttttcggggccccgtacccggacgggtcccgttaccgggaacgggggaacgggggtcgttaggggacgggttttcgggcgttcgggaggtccgttaaggttttcggggttagggttaggtcggggtacgcccggaaggtaaccacgttaaacgtttaacggaaacccgtttccgcgggtaccgaggggtccctaagttttctttaacgtccgtaccgaagtacgtaactaaccttccgaaagtaacctagtactcgttattaccgtcgacgtgttacccgaaccgtaggtacctagggtaggtaacgggtaccgaaccgggtaccaacccggggttacttaagttagttttaacggtttggttaaacggtttaaaggtcggggtaattggggtaccggttacgtacccggtacgggtttacccgggttacggggggtaccccccggtaacggttcccgggtaccttacccccggg

SEQ ID NO: 170299 - DNA, 556 bp, Homo sapiens
  misc_feature: GYAE6OF01A1XA1.47.77.G11.1.454.CMB.1.raw
  modified_base (167)..(167): a, c, t, g, unknown or other
  misc_feature (167)..(167): n is a, c, g, or t
  modified_base (241)..(241): a, c, t, g, unknown or other
  misc_feature (241)..(241): n is a, c, g, or t
  modified_base (510)..(510): a, c, t, g, unknown or other
  misc_feature (510)..(510): n is a, c, g, or t
  modified_base (517)..(523): a, c, t, g, unknown or other
  misc_feature (517)..(523): n is a, c, g, or t
  modified_base (525)..(556): a, c, t, g, unknown or other
  misc_feature (525)..(556): n is a, c, g, or t
tcagagctcacgtacacgaccggtgctcgatttagctagtcactcaaggggaaaggggctggagtgggtctcaggcattggtggtagtggtgccaggacacattacgtaaagtccctgcagggccgattcttatctccagagacaattccaggaacatactgattcngcagttgaccagactggagagtcgaggaccacgggccgttaattattagttgtagtttaaagtgggaattgggnggtctacgtactcgttggggggcccgggaaccctggtccaccgttctcttcacgccttcccaaccgacgggccctagttccggtccttcccccgtggccctcccctgcctccgaggcgctacctcggtcggggccacgacggcccgggtcccgtgggcctcggtccggtggtaccaaacggggtacccttaccgttacccgttacggcgtacgtacctcgtcgggtacggccgggtcgtacggaccggacggccggtaccgagtacggntgatcgnnnnnnncnnnnnnnnnnnnnnnnnnnnnnnnnnnnnnnn

SEQ ID NO: 170300 - DNA, 880 bp, Homo sapiens
  misc_feature: GYAE6OF01C6G2R.47.77.G11.1.454.CMB.1.raw
tcagagctcacgtacacgaccggtgctcgatttagctagtcactcaagggaaagggagctctgagagaggagcccagccctgggattttcaggttgttttcatttggtgatcaggactgaacagagagaactcaccatggtagtttggctgacctggtctttttctgtggacttaattttaaaagtgtccagtggtgaggtgcagcgtgggtggacgtcggtgggggagtcttagtacgacggtcccggttcggggggtccctagacggtaccttccgtccgtgccgtccacgtccctcgtggtactttcctttccgttttaagttaagtttactcgacctaagttcggtaaccgtttcggggtccccgaccgtagggtcccgttaccgggaagggggtaacggggtccggttaggggtaacggttcggggttcctacggacggttaccgttaggtttcgggtagggttaggttcgggtcgaccggtaacggtaacgtaacgttaacgttaacggttaaaccgtcccgtagaccggtacgggtacccgttattttccgtttaactccgttaccgaagtaacgtaaccgttaaacgtttaccgaaaggtaaccgtaagttaccttaaggttacgtttccgtagtaccggttaacgttacccgaacgttaaggaaccgttaaggaacggttacgtacgggaaccggtaccggaaccggtttaccttaaaggttttaattttacggttaaaggtttaacgggttaaaagggttcgggttaaggtttcggggttaccggtacggttaacccggttacggttcccgggggttaacccgggggtacccgggtttaaacccggtcgggtttaccccgttaaccccgg

SEQ ID NO: 170301 - DNA, 847 bp, Homo sapiens
  misc_feature: GYAE6OF01BGXI5.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggtctttttcttgtggtacttaattttaaaagtgtccagtgtgaggtgcagcgtggtggagtcggtgggggaggtcttagtacaggccggttcggggggtccctaggacgaccttccgtccgtgccgcacgtccgtcgtaggtactttcctttaccgttttaaggttacgtttactcgtcctagtacggtacgttcgggtccccgacccgaggtcccgtaccgggaacggggggtaacgggggtcgttaggggtacgggttcggggtaccgtacggtaacgggtccgttagggttttcggggtagggttacgggttggggttacggaccgtagggtaacctaacgttaacgttttaaacccggttaaaacgttccccgtacgggaccggtaacggggtacccgttaacgtttttaccttttacgtacccgttaaccgtaaaggtaaccggtaaaccttaaacgtttacccggaaaaacgggtaaaccttaaacgttaaccgttacgttaaccgtttacgtacggttaacccgttacggttaccgaacgttaacggtaccgtaggaacgtacgggtacggaacggtaaccgtaccggtacttaagtagtttacgttagtaaggttaagtgggtagtcggtagccgtacggtacgttcggggtaccggggacccggtaccgtggtcctcgtccttacg

SEQ ID NO: 170302 - DNA, 485 bp, Homo sapiens
  misc_feature: GYAE6OF01BHVL3.47.77.G11.1.454.CMB.1.raw
  modified_base (468)..(468): a, c, t, g, unknown or other
  misc_feature (468)..(468): n is a, c, g, or t
  modified_base (470)..(485): a, c, t, g, unknown or other
  misc_feature (470)..(485): n is a, c, g, or t
tcagagctcacgtacacgaccggtgctcgatttagctagtcactcaaggggaaagggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatatttatgtagttaaagtgggatggtggctacgctcggttcgggggcccgggacctggtcaccgtctctcacgcttccaccgacggcccagttccggttcccttcccccgtcggcccgtccccgtcgtccctccgacgggaccgcccgtaccgtcggtcgggggccacgacggccgggcccgtcgggctcggccgtggtacaacgggtcttaccttccgtacggtcgacgtctcgtgacggcggcgtcggcgaggcgacgangnnnnnnnnnnnnnnnn

SEQ ID NO: 170303 - DNA, 417 bp, Homo sapiens
  misc_feature: GYAE6OF02HFM1H.47.77.G11.1.454.CMB.1.raw
  modified_base (405)..(417): a, c, t, g, unknown or other
  misc_feature (405)..(417): n is a, c, g, or t
tcagagctcacgtacacgaccggtgctcgatttagctagtcactcaagggaaagggcgtggagtgggtctcaggcattggtggtagtggtgccaggacacattacgtaagtccctgcagggccgattctttatctccagagacaattccaggaacatactgattctgcagttgaccagacctgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggctacttcctacgtgagctctgagcggctggcaggcgcatagnnnnnnnnnnnnn

SEQ ID NO: 170304 - DNA, 413 bp, Homo sapiens
  misc_feature: GYAE6OF02GVKQ8.47.77.G11.1.454.CMB.1.raw
  modified_base (409)..(413): a, c, t, g, unknown or other
  misc_feature (409)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnn

SEQ ID NO: 170305 - DNA, 411 bp, Homo sapiens
  misc_feature: GYAE6OF02F11MP.47.77.G11.1.454.CMB.1.raw
  modified_base (407)..(411): a, c, t, g, unknown or other
  misc_feature (407)..(411): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnn

SEQ ID NO: 170306 - DNA, 412 bp, Homo sapiens
  misc_feature: GYAE6OF02IHCEQ.47.77.G11.1.454.CMB.1.raw
  modified_base (406)..(412): a, c, t, g, unknown or other
  misc_feature (406)..(412): n is a, c, g, or t
tcagagctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctggggcacagcggcctgggctgcctggtcaaggactacttcctacgtgagctctgagcgggctggcaaggcgcatagnnnnnnn

SEQ ID NO: 170307 - DNA, 408 bp, Homo sapiens
  misc_feature: GYAE6OF02GS6DY.47.77.G11.1.454.CMB.1.raw
  modified_base (404)..(408): a, c, t, g, unknown or other
  misc_feature (404)..(408): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattatgtgttaaatgggatggtgctacgactcttggggccgggaacctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnn

SEQ ID NO: 170308 - DNA, 411 bp, Homo sapiens
  misc_feature: GYAE6OF02GLJMN.47.77.G11.1.454.CMB.1.raw
  modified_base (407)..(411): a, c, t, g, unknown or other
  misc_feature (407)..(411): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttccccctggcgccctgctccaggagcacctctgggggcacagcggccctggggctgcctggtcaaggctacttcctacgtgagctctgagcgggctggcaaggcgcatagnnnnn

SEQ ID NO: 170309 - DNA, 411 bp, Homo sapiens
  misc_feature: GYAE6OF02HSM3J.47.77.G11.1.454.CMB.1.raw
  modified_base (406)..(411): a, c, t, g, unknown or other
  misc_feature (406)..(411): n is a, c, g, or t
tcagagctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtgctacgactcttggggccgggaaccctggtcaccgtctcttcagcttccaccaagggcccatcggtcttccccctggcgccctgctccaggagcacctctgggggcacagcggccctggggctgcctggtcaaggctacttcctacgtgagctctgagcgggctggcaaggcgcatagnnnnnn

SEQ ID NO: 170310 - DNA, 412 bp, Homo sapiens
  misc_feature: GYAE6OF02I7WGL.47.77.G11.1.454.CMB.1.raw
  modified_base (407)..(412): a, c, t, g, unknown or other
  misc_feature (407)..(412): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctggggcacagcggccctgggctgcctggtcaaggctacttcctacgtgagctctgagcgggctggcaaggcgcatagnnnnnn

SEQ ID NO: 170311 - DNA, 542 bp, Homo sapiens
  misc_feature: GYAE6OF02GTGFZ.47.77.G11.1.454.CMB.1.raw
  modified_base (404)..(404): a, c, t, g, unknown or other
  misc_feature (404)..(404): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggcttttcttgtggctattttaaaagtgtccagtgtgaggtgcagctggtggagtctgggggaggcttagtacagcctggggggtccctgagactctcctgcgcagcctctggattctcctttagtagttatgccatgacttgggtccgcaggctccgaggggaagggctgggagtgggtctcgaggcagttggtggtagtgggtgccaggacacattacgtaaagtccctgcagggccgattctttanctccagagacaattccaagaacatactgtattctgctagttgaccagactgagagtcgaggacacggccgtatattattgtagttaagtgggatgggtggctacgacttcggttggggccgggtacctggtctaccgg

SEQ ID NO: 170312 - DNA, 412 bp, Homo sapiens
  misc_feature: GYAE6OF02FNL48.47.77.G11.1.454.CMB.1.raw
  modified_base (408)..(412): a, c, t, g, unknown or other
  misc_feature (408)..(412): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnn

SEQ ID NO: 170313 - DNA, 426 bp, Homo sapiens
  misc_feature: GYAE6OF02ILV2O.47.77.G11.1.454.CMB.1.raw
  modified_base (414)..(415): a, c, t, g, unknown or other
  misc_feature (414)..(415): n is a, c, g, or t
  modified_base (417)..(426): a, c, t, g, unknown or other
  misc_feature (417)..(426): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgaattctttatctccagagacaattccaggaacatactgatttctgcagtttgaccagactgagagtcgaggacacggccgtatattattgtgttaaatgggatggtggctacggactcttggggccgggaaccctggtcaccgtctcttcaggcttccaccaagggcccatcggtcttccccctggcgccctgctccaggacgcgacctctgggggcacgagcggcctgggctgcctggtcaaggctacttcctacgtgagctctgagcgggctggcaaggcgcatagnnannnnnnnnnn

SEQ ID NO: 170314 - DNA, 414 bp, Homo sapiens
  misc_feature: GYAE6OF02H0GO2.47.77.G11.1.454.CMB.1.raw
  modified_base (408)..(414): a, c, t, g, unknown or other
  misc_feature (408)..(414): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnnnn

SEQ ID NO: 170315 - DNA, 414 bp, Homo sapiens
  misc_feature: GYAE6OF02GY2LG.47.77.G11.1.454.CMB.1.raw
  modified_base (409)..(414): a, c, t, g, unknown or other
  misc_feature (409)..(414): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctggtcaccgtctcttcagcttccaccaagggcccatcggtcttccccctggcgccctgctccaggagcacctctgggggcacagcggccctggggctgcctggtcaaggactacttcctacgtgagctctgagcgggctggcaaggcgcatagnnnnnn

SEQ ID NO: 170316 - DNA, 411 bp, Homo sapiens
  misc_feature: GYAE6OF02I2GJC.47.77.G11.1.454.CMB.1.raw
  modified_base (406)..(411): a, c, t, g, unknown or other
  misc_feature (406)..(411): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctggtcaccgtctcttcagcttccaccaagggcccatcggtcttccccctggcgccctgctccaggagcacctctgggggcacagcggccctgggctgcctggtcaaggactacttcctatgtatactctgagcggctggcaggcgcatagnnnnnn

SEQ ID NO: 170317 - DNA, 433 bp, Homo sapiens
  misc_feature: GYAE6OF02HXSDH.47.77.G11.1.454.CMB.1.raw
  modified_base (205)..(205): a, c, t, g, unknown or other
  misc_feature (205)..(205): n is a, c, g, or t
  modified_base (405)..(405): a, c, t, g, unknown or other
  misc_feature (405)..(405): n is a, c, g, or t
  modified_base (411)..(433): a, c, t, g, unknown or other
  misc_feature (411)..(433): n is a, c, g, or t
tcagagctcacgtacacgaccggtgctcgatttagctagtcactcaagggaaaggggcgtggagtgggtctcaggcattggtggtagtggtgccaggacacattacgtaaagtccctgcagggccgattctttatctccagagacaattccaggaacatactgattctgcagttgaccagactgagagtcgaggacacggcgtanattatgtgttaaaatgagatggtggctaacgactcttgggggccggggaaacctgggtacaccgtctcttcagcttccaccaagggcccatcggtcttcccctgcgccctgctccaggagcacctctggggcacagcggccctgggctgcctggtcaaggactacttcctaacgtgagctctgagcgggctggcaaggcncatagnnnnnnnnnnnnnnnnnnnnnnn

SEQ ID NO: 170318 - DNA, 443 bp, Homo sapiens
  misc_feature: GYAE6OF02GLU9F.47.77.G11.1.454.CMB.1.raw
  modified_base (421)..(443): a, c, t, g, unknown or other
  misc_feature (421)..(443): n is a, c, g, or t
tcagagctcacgtacacgaccggtgctcgatttagctagtcactcaagggtaaagggggctggagtgggtctcaggcattgggtggtagtgggtgtccaggacacattacgtaaagtccctgcagggccgattctttatctccagagacaattccgaggaacatactgtattctgcagtttgaccagactgagagtcgaggacacggccgtatattattggtgttaaatgggatggtggcgtacgactcttggggccgggaaccctgggtcaccgtctcttcagcttccaccaagggcccatcggtcttccccctggcgccctgcctccaggagcaccgtctgggggcacagcggcctgggctgcctggtcaaggactacttcctacgtgacgctctgacgcggctggcaaggcgcatagnnnnnnnnnnnnnnnnnnnnnnn

SEQ ID NO: 170319 - DNA, 410 bp, Homo sapiens
  misc_feature: GYAE6OF02ILL8V.47.77.G11.1.454.CMB.1.raw
  modified_base (405)..(410): a, c, t, g, unknown or other
  misc_feature (405)..(410): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttccccctggcgccctgctccaggagcacctctggggcacagcggcctgggctgcctggtcaaggactacttcctacgtgagctctgagcgggctggcaaggcgcatagnnnnnn

SEQ ID NO: 170320 - DNA, 413 bp, Homo sapiens
  misc_feature: GYAE6OF02IFALE.47.77.G11.1.454.CMB.1.raw
  modified_base (409)..(413): a, c, t, g, unknown or other
  misc_feature (409)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggccgccctgcctccaggacgcacctccgagagcacagcggccctgggctgcctggtcaaggctacttctatgtatactctgagcgggctggcaaggcgcatagnnnnn

SEQ ID NO: 170321 - DNA, 413 bp, Homo sapiens
  misc_feature: GYAE6OF02F445P.47.77.G11.1.454.CMB.1.raw
  modified_base (409)..(413): a, c, t, g, unknown or other
  misc_feature (409)..(413): n is a, c, g, or t
tcagagctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctgggcaaggcgcatagnnnnn

SEQ ID NO: 170322 - DNA, 416 bp, Homo sapiens
  misc_feature: GYAE6OF02JFX2W.47.77.G11.1.454.CMB.1.raw
  modified_base (400)..(400): a, c, t, g, unknown or other
  misc_feature (400)..(400): n is a, c, g, or t
  modified_base (406)..(416): a, c, t, g, unknown or other
  misc_feature (406)..(416): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttccccctggcgccctgctccaggacgcacctctggggcacagcggccctgggctgcctggtcaaggctacttcctacgtcgagctctgagcggctggcaaggcncatagnnnnnnnnnnn

SEQ ID NO: 170323 - DNA, 430 bp, Homo sapiens
  misc_feature: GYAE6OF02FQSW3.47.77.G11.1.454.CMB.1.raw
  modified_base (424)..(430): a, c, t, g, unknown or other
  misc_feature (424)..(430): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatatttctgtgcgaaagtctatagcagtgccccctagcgcacttctttgacttctggggccagggaatcctggtcaccgtctccacagcctccaccaagggcccatcggtcttcccctggcgccctgctccaggagcacctccgagagcacagcggccctgggctgcctggtcaaggctacttcctacgtgagctctgagcgggctggcaaggcgcatagnnnnnnn

SEQ ID NO: 170324 - DNA, 412 bp, Homo sapiens
  misc_feature: GYAE6OF02IM78F.47.77.G11.1.454.CMB.1.raw
  modified_base (404)..(412): a, c, t, g, unknown or other
  misc_feature (404)..(412): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcgtcttccccctggcgccctgctccaggagcacctctgggggcacagcggccctggggctgcctggtcaaggctactcctacgtgagctctgagcgggctggcaaggcgcatagnnnnnnnnn

SEQ ID NO: 170325 - DNA, 487 bp, Homo sapiens
  misc_feature: GYAE6OF02FFH1A.47.77.G11.1.454.CMB.1.raw
  modified_base (132)..(132): a, c, t, g, unknown or other
  misc_feature (132)..(132): n is a, c, g, or t
  modified_base (155)..(155): a, c, t, g, unknown or other
  misc_feature (155)..(155): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (459)..(459): a, c, t, g, unknown or other
  misc_feature (459)..(459): n is a, c, g, or t
  modified_base (476)..(487): a, c, t, g, unknown or other
  misc_feature (476)..(487): n is a, c, g, or t
tcagagctcacgtacacgaccggtgctcgatttagctagtcactccagggaaggggctggagtgggtctcaggcattggtggtagtggtgccaggacacattacgtaaagtccctgcaggccgtattcttanctcagagacatccagaacatacngtattctgcagttcgaccagactgagacgtacggacggacacggtacttattattagttagttagttaaagtgggtatggtcgtcctaccggtacgtcggtcggggaccggtacctcggtcctaccgtctctcacgtcctaccgacgacggtcctacgtccgtccctacccgngaccnccgtgcacgagtcgcctacggtggtacgggcctacggccggtccggtccgtcggtcacggttaccgtacggtactaacggtccttaccgtccgaggttgaccgtcgtaggaggccgggtcggtacnggaaccgaggtcaatgnnnnnnnnnnnn

SEQ ID NO: 170326 - DNA, 416 bp, Homo sapiens
  misc_feature: GYAE6OF02FXTYR.47.77.G11.1.454.CMB.1.raw
  modified_base (410)..(416): a, c, t, g, unknown or other
  misc_feature (410)..(416): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctgggcaaggcgcatagnnnnnnn

SEQ ID NO: 170327 - DNA, 409 bp, Homo sapiens
  misc_feature: GYAE6OF02H23LV.47.77.G11.1.454.CMB.1.raw
  modified_base (405)..(409): a, c, t, g, unknown or other
  misc_feature (405)..(409): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttatctcagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggcctgggctgcctggtcaaggactacttcctacgtgagctctgagcgggctggcaaggcgcatagnnnnn

SEQ ID NO: 170328 - DNA, 412 bp, Homo sapiens
  misc_feature: GYAE6OF02F3JTC.47.77.G11.1.454.CMB.1.raw
  modified_base (409)..(412): a, c, t, g, unknown or other
  misc_feature (409)..(412): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctggggctgcctggtcaaggactacttcctacgtgagctctgagcgggctggcaaggcgcatagnnnn

SEQ ID NO: 170329 - DNA, 538 bp, Homo sapiens
  misc_feature: GYAE6OF02HITW7.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttagtacagcctgggggtccctgagactctcctgcgcagcctctggattctcctttagtagttatgccatgacttgggtccgccaggctccagggaagggctgggagtgggtctcgaggcattggtggtagtggtgccaggacacattacgtaaagtccctgcagggccattctttatctccagagacaattccaggaacatactgattctgcagttgaccagactgagagtcgaggacacggcctaatattattgtagttaatgggatgggtgctacgacgttcgttggggcccgggaacctgggtaccaccgtctcg

SEQ ID NO: 170330 - DNA, 411 bp, Homo sapiens
  misc_feature: GYAE6OF02GUCMF.47.77.G11.1.454.CMB.1.raw
  modified_base (406)..(411): a, c, t, g, unknown or other
  misc_feature (406)..(411): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttcccccctggcgccctgctccaggagcacctctggggcacagcggccctgggctgcctggtcaaggctacttctacgtgagctctgagcggctggcaaggcgcatagnnnnnn

SEQ ID NO: 170331 - DNA, 409 bp, Homo sapiens
  misc_feature: GYAE6OF02IAQHR.47.77.G11.1.454.CMB.1.raw
  modified_base (407)..(409): a, c, t, g, unknown or other
  misc_feature (407)..(409): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnn

SEQ ID NO: 170332 - DNA, 407 bp, Homo sapiens
  misc_feature: GYAE6OF02H1WXF.47.77.G11.1.454.CMB.1.raw
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (396)..(407): a, c, t, g, unknown or other
  misc_feature (396)..(407): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcacgtctcttcagctcacaaggccatcgtctcccngcncctgctccaggancacctcgtggggcacgagccggccctgggctgcctggtcaaggctacttcctagtgagctctgagcgggctggcaaggcncatagnnnnnnnnnnnn

SEQ ID NO: 170333 - DNA, 650 bp, Homo sapiens
  misc_feature: GYAE6OF02GDWW7.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttagtacagcctggggggtccctgagactctcctgcgcagcctctggtattccttctttagtagttatcgccatgtacgttcgggtcccgccgacggcctccgaaggggaacggggcgtgggaggtgggtctcgaggctagttgggtggtaggtggtcgccgaggacactagttaacgtaaacgtcctgcgacgggccgtatttctttatcctaccagacgactaattccgaaggaacatactagtacttcgtcgctaggttacgaacctagacgtagaagtacgtacggaaggaacctaccggttaccgttaattacgttagtttgttaagtttaaggtgggtaagttgggtacggttactaaccggtcgttaccgggttcggggggaccccgggttaacccgttgggtaccctacccggttccttaccg

SEQ ID NO: 170334 - DNA, 596 bp, Homo sapiens
  misc_feature: GYAE6OF02J1DNE.47.77.G11.1.454.CMB.1.raw
  modified_base (454)..(454): a, c, t, g, unknown or other
  misc_feature (454)..(454): n is a, c, g, or t
  modified_base (477)..(477): a, c, t, g, unknown or other
  misc_feature (477)..(477): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaagtgtccagtgtgaggtgcagctggtggagtctgggggaggcttagtacagccgtggggggtccctgagactctcctgcgcagcctctggattctcctttagtagttatgccatgacttgggtccgccaggcctccgagggaagggctgggagtgggtctcgaggcagttggtggtaggtggtcgccgagggacacgtagtttacgtaaacgtccctgacgacgggccgtattctttatcctccgagacactaatccgaagaacataccgtgattccngactagttgaccagtactgaagngtacgaggacacgggtctaatagttattgtagttaagtgggtaagttgggtacgtacgtaccgtacgttcggttcggggggtaacccgggtacccgttgggacctacccggtcgttacg

SEQ ID NO: 170335 - DNA, 414 bp, Homo sapiens
  misc_feature: GYAE6OF02I4A9K.47.77.G11.1.454.CMB.1.raw
  modified_base (382)..(382): a, c, t, g, unknown or other
  misc_feature (382)..(382): n is a, c, g, or t
  modified_base (407)..(414): a, c, t, g, unknown or other
  misc_feature (407)..(414): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggctacttccacgtgagctntgagcgggctggcaaggcgcatagnnnnnnnn

SEQ ID NO: 170336 - DNA, 409 bp, Homo sapiens
  misc_feature: GYAE6OF02H4UM4.47.77.G11.1.454.CMB.1.raw
  modified_base (323)..(323): a, c, t, g, unknown or other
  misc_feature (323)..(323): n is a, c, g, or t
  modified_base (405)..(409): a, c, t, g, unknown or other
  misc_feature (405)..(409): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggccggggaaccctggtcacgtctcttcagcttccaccaagggcccatcggtcttccccctggcgccctgctccaggancacctctgggggcacagcggcctgggctgcctggtcaaggctactcctacgtgagtctgagcgggctggcaaggcgcatagnnnnn

SEQ ID NO: 170337 - DNA, 426 bp, Homo sapiens
  misc_feature: GYAE6OF02I4LB0.47.77.G11.1.454.CMB.1.raw
  modified_base (415)..(426): a, c, t, g, unknown or other
  misc_feature (415)..(426): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcaccgtctcttcagcttcaccaaggcccatccggtcttcccctggcgccctgctccaggagcacctcgtggggcacgagccggcctggggctcgccgtggtacgaaggtacctacttcctacgtgagtctctgagcgggctggcacggcgcagtagnnnnnnnnnnnn

SEQ ID NO: 170338 - DNA, 540 bp, Homo sapiens
  misc_feature: GYAE6OF02IL1B8.47.77.G11.1.454.CMB.1.raw
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(482): a, c, t, g, unknown or other
  misc_feature (481)..(482): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (531)..(531): a, c, t, g, unknown or other
  misc_feature (531)..(531): n is a, c, g, or t
  modified_base (539)..(539): a, c, t, g, unknown or other
  misc_feature (539)..(539): n is a, c, g, or t
tcagagctcacgtacacgaccggtgctcgattttagctagtcactcctaggggtaagggggctggagtgggtctcaggcacttggtggtagtggtgccagggacacattacggtaaaccgtccctgcagggcccgagttctttatctccagagacaagttccaggaacatactgattctgcagttcgacagactcgagcgtcgaggacaccggccgtatattattgtgttaaagtgggatggtggctacgactcttggggccgggaacccgtggtcaccgtcgtcttacagctttcaccaagggcccaatcggtccttccccctggccgaccctcgacgtacctacgggagcctacctcgtggggctacagcgccctgggctcgcctggtacaagctacgttcctacgtgagctcgtggaggcgggatgggacgaagggcgacgtactaagcgtancgatnagcncncngncnanantntnnatatatananananatctcncncnctctcgacgacgacgacgacgaganactacagng

SEQ ID NO: 170339 - DNA, 418 bp, Homo sapiens
  misc_feature: GYAE6OF02FI9L2.47.77.G11.1.454.CMB.1.raw
  modified_base (410)..(418): a, c, t, g, unknown or other
  misc_feature (410)..(418): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattctaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttcccccctggcgccctgctccaggagcacctctgggggcacagcggccctggggctgcctggtcaaggactacttcctacgtgagctctgagcgggctggcaaggcgcatagnnnnnnnnn

SEQ ID NO: 170340 - DNA, 413 bp, Homo sapiens
  misc_feature: GYAE6OF02G325N.47.77.G11.1.454.CMB.1.raw
  modified_base (408)..(413): a, c, t, g, unknown or other
  misc_feature (408)..(413): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttgggggccgggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnnn

SEQ ID NO: 170341 - DNA, 633 bp, Homo sapiens
  misc_feature: GYAE6OF02I2IQ2.47.77.G11.1.454.CMB.1.raw
  modified_base (308)..(308): a, c, t, g, unknown or other
  misc_feature (308)..(308): n is a, c, g, or t
  modified_base (472)..(472): a, c, t, g, unknown or other
  misc_feature (472)..(472): n is a, c, g, or t
  modified_base (509)..(509): a, c, t, g, unknown or other
  misc_feature (509)..(509): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggcttttcttgtggctatttaaaaagtgtccagtgtgaggtgcagctggtggagtcgtgggggaggcttagtacagccgtggggggtccctgagactctcctgcgcagcctctggattctcctttagtagttatgccatgacgttgggtcccnccgaggcctccgaggggaacggggctgggagtgggtctcgagggctagttgggtggtagtgggtgccgagggacactagttaacgtaaacgtcccgtgcgagggcccgtatttccgtttatcctccgaagtaacgacaattccgaaggtaacatactgattcgngcagttcgaccagacctgaggacgtacggaggtaacnccgggacaagttatacgtttattaggttacgtttaaaagtggggtacttaggggtcggtacgttaacggtaccgttaccggtttaccggggggacccggggttaacccctggggttaaccccgg

SEQ ID NO: 170342 - DNA, 418 bp, Homo sapiens
  misc_feature: GYAE6OF02G9O98.47.77.G11.1.454.CMB.1.raw
  modified_base (410)..(418): a, c, t, g, unknown or other
  misc_feature (410)..(418): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttcccccctggcgccctgctccaggagcacctctgggggcacagcggccctgggctgcctggtcaaggctacttcctacgtgagctctgagcgggctggcaagggcgcatagnnnnnnnnn

SEQ ID NO: 170343 - DNA, 417 bp, Homo sapiens
  misc_feature: GYAE6OF02FX8H9.47.77.G11.1.454.CMB.1.raw
  modified_base (411)..(417): a, c, t, g, unknown or other
  misc_feature (411)..(417): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaaccctggtcaccgtctcttcagcttccaccaagggcccatcgtcttccccctcggcgccctcgctccaggagcacctctggggcgacagcggccctggctgcctggtcgaaggactacttcctacgtcgagctctgagcgggctggcaaggcgcatagnnnnnnn

SEQ ID NO: 170344 - DNA, 413 bp, Homo sapiens
  misc_feature: GYAE6OF02H1NSH.47.77.G11.1.454.CMB.1.raw
  modified_base (408)..(413): a, c, t, g, unknown or other
  misc_feature (408)..(413): n is a, c, g, or t
tcagagctcacgtacacgaccggtgctcgatttagctagtcactcaagggaaaggggctggagtgggtctcaggcattggtggtagtggttccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggccgggaacctggtcaccgtctcttcagcttccaccaagggcccatcggtcttccccctggcgccctgctccaggagcacctctgggggcacagcggccctgggctgcctggtcaaggctactcctacgtgagctctgagcgggctgggcaaggcgcatagnnnnnn

SEQ ID NO: 170345 - DNA, 461 bp, Homo sapiens
  misc_feature: GYAE6OF02JUY35.47.77.G11.1.454.CMB.1.raw
  modified_base (341)..(341): a, c, t, g, unknown or other
  misc_feature (341)..(341): n is a, c, g, or t
  modified_base (429)..(429): a, c, t, g, unknown or other
  misc_feature (429)..(429): n is a, c, g, or t
  modified_base (431)..(461): a, c, t, g, unknown or other
  misc_feature (431)..(461): n is a, c, g, or t
tcagagctcacgtacacgaccggtgctcgatttagctagtcactcaagggaaaggggcgtggagtgggtctcaggcattggtggtagtggtgccaggacacattacgtaaagtccctgcaggccgattctttatctccagagacaattccaggaacatactgattctgcagttgaccagactgagagtcgaggacacggccgtatattattgtgttaaaatgggatggtggctacgactcgttgggggccggggaacctgggtcaccgtctcttcagcttccaccaagggcccatcggtcttccccctggccgccctgctccaggcgcacctctgggggcncgagccggccctggggcctgcctggtccaagggtactacgtttcccacgttgagctctgaggccgggctggcgaaggcgacacgtagnannnnnnnnnnnnnnnnnnnnnnnnnnnnnnn

SEQ ID NO: 170346 - DNA, 408 bp, Homo sapiens
  misc_feature: GYAE6OF02FWCPV.47.77.G11.1.454.CMB.1.raw
  modified_base (402)..(408): a, c, t, g, unknown or other
  misc_feature (402)..(408): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttccccctggcgccctgctccagagcacctctggggcacagcggcctgggctgcctggtcaaggactacttcctacgtgagctctgagcggctggcaaggcgcatgnnnnnnn

SEQ ID NO: 170347 - DNA, 623 bp, Homo sapiens
  misc_feature: GYAE6OF02G4N2A.47.77.G11.1.454.CMB.1.raw
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagcctggggggtccctgagactctcctgcgcagcctctggattctcctttagtagttatgccatgacttgggtccgccaggctccgaggggagggctggagtgggtctcgaggcagttgggtggtagtggtgccgaggacacatttacgtaaacgtccctgcacgggcctatttctttatctacaagacgactaaattccgaaaggaactataacgtgaatttctaggctaaggttgaaccctagtactgaggtaacgtcggaaggaccaccgggaccgttaattagttagttgttagttaaagttggggtaattggggtacggtacttaacggtacgtttcggttacggggggaccccgggtaaacccttgggtaccctaccggttccttaccgg

SEQ ID NO: 170348 - DNA, 616 bp, Homo sapiens
  misc_feature: GYAE6OF02JBRNI.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggcttttcttgtggctattttaaaaagtgtccagtgtgaggtgcagctggtggagtctgggggaggcttagtacagcctggggggtccctgagactctcctgcgcagcctctggattctccttagtagttatgccatgacttgggtccgccaggctccgaggggaacggggctgggagtgggtctcgaggcagttggtggtagtgggtcgccgaggacacgagttacgtaaagtccctagcgaggggcccgtatttcctttaatccttaccaaggtacgaacctaaacgtttcccgaaagggtaaccaataacctggtaatttcgtagactagttacgaccaagacttaggagagtccggaggaccacggccgtaatatttagttgtagttaaagtgggtatgggtgacgttaacgacgttcggttacgggggaccgggtaacccgttgggtccctaccgg

SEQ ID NO: 170349 - DNA, 565 bp, Homo sapiens
  misc_feature: GYAE6OF02GCX9Y.47.77.G11.1.454.CMB.1.raw
  modified_base (445)..(445): a, c, t, g, unknown or other
  misc_feature (445)..(445): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggatattttaaaaagtgtccagtgtgaggtgcagctggtggagtctgggggaggcttagtacagccgtggggggtccctgagactctcctgcgcagcctctggattctcctttagtagttatgccatgacttgggtccgccgaggctccgaggggaaggggctgggagtgggtctcgaggcagttgggtggtagtgggtgccgaggacacattacgtaaagtccctgcgagggccgattctttatctcagagacaattccaagaacatactgattcngctagttgaccagactgagacgtcgaggccacggcgttaatattagttgtagttaaagtggggaattgggtgtctacgacgttcggttgggggacccgggtaaccctgggtacctacccg

SEQ ID NO: 170350 - DNA, 413 bp, Homo sapiens
  misc_feature: GYAE6OF02HRX1F.47.77.G11.1.454.CMB.1.raw
  modified_base (409)..(413): a, c, t, g, unknown or other
  misc_feature (409)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggccccatcggtcttcccccctggcgcccctgctccaggagcacctctgggggcacagcggccctgggctgcctggtcaaggactacttcctacgtgagctctgagcgggctggcaaggcgcatagnnnnn

SEQ ID NO: 170351 - DNA, 611 bp, Homo sapiens
  misc_feature: GYAE6OF02IWLOH.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctaattttaaaaagtgtccagtgtgaggtgcagctggtggagtcgtgggggaggcttagtacagccgtgggggtccctgagactctcctgcgcagcctctggattctcctttagtagttatgccatgacgttgggtcccgccgaggctccgaggggaaggggcgtgggaggtgggtctcgaggctagttggtggtagtgggtgccgaggacactagttaacgtaaagtccctgcgagggcccgtatttctttactcctaccgagacgactaattccgaaggaacatacgtgtaattcgtgctagttcgaccagactgagtagtcggagacgacggtaccttaatacgtttagttgtaagtttaaagtgggtaagttgggtggtacctacggtacgttcgggttcgggggacccgggtaacccgttgggtaccctacccgg

SEQ ID NO: 170352 - DNA, 415 bp, Homo sapiens
  misc_feature: GYAE6OF02GQ0PK.47.77.G11.1.454.CMB.1.raw
  modified_base (410)..(415): a, c, t, g, unknown or other
  misc_feature (410)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcgttcttccccctggcgccctgctccaggagcacctctgggggcacagcggccctggggctgcctggtcaaggactacttcctacgtgagctctgagcgggctggcaaggcgcatagnnnnnn

SEQ ID NO: 170353 - DNA, 549 bp, Homo sapiens
  misc_feature: GYAE6OF02G5T3R.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttctgtggctatttaaaagtgtccagtgtgaggtgcagctggtggagtcgtgggggaggcttaggtacagcctggggggtccctgagactctcctgcgcagcctctggattctcctttagtagttatgccatgacttgggtccgccaggctccgaggggaaggggctgggagtgggtctcgaggcatttgggtggtagtgggtgccagggacacattacgtaaagtccctgcagggccattctttatctccagagacaattccaggaacatactgattctgctagttgaccagactgagagtcgaggacacggcctaatacttattgtagttaaagtgggatgggtgctacgcgttcgtcggggacccgggaccgtggtactacccgg

SEQ ID NO: 170354 - DNA, 531 bp, Homo sapiens
  misc_feature: GYAE6OF02HZNLF.47.77.G11.1.454.CMB.1.raw
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(531): a, c, t, g, unknown or other
  misc_feature (498)..(531): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgatttcttttatctccagagacaattccaggaacatactgattctgcagttgaccagactgagagtcgaggacacggccgtatattatgtgttaaatgggatggtggctacgacttcttgggggccgggaaccctggtcaccgtctcttcagcttccaccaagggcccatcggtccttccccctggccgccctgctcccgagggacgccacccttcgtcgggggccacgacggccggccccgtgggggcctcggcccgttgggtcccaaaggggtaccttacgtttcccttaacggtcggaacgtccttccgtggacgggtccggggtaccgttggggacccgaaagggtcccggactaacgttaaggcngngnnnnnnnnnnnnnnnnnnnnnnnnnnnnnnnnnn

SEQ ID NO: 170355 - DNA, 413 bp, Homo sapiens
  misc_feature: GYAE6OF02GMRDD.47.77.G11.1.454.CMB.1.raw
  modified_base (402)..(402): a, c, t, g, unknown or other
  misc_feature (402)..(402): n is a, c, g, or t
  modified_base (407)..(413): a, c, t, g, unknown or other
  misc_feature (407)..(413): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaaatgggatggtggctacgactcgttggggccgggaaccctggtcaccgtctcttcagcttccaccaaggcccatcggtcttccccctggcgccctgctccaggacgcacctcgtggggcacagcggccctgggctgcctggtcaaggactacttcctatgtatactctgagcggctggcaggcncatgnnnnnnn

SEQ ID NO: 170356 - DNA, 566 bp, Homo sapiens
  misc_feature: GYAE6OF02I5MNI.47.77.G11.1.454.CMB.1.raw
  modified_base (450)..(450): a, c, t, g, unknown or other
  misc_feature (450)..(450): n is a, c, g, or t
  modified_base (562)..(562): a, c, t, g, unknown or other
  misc_feature (562)..(562): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtgggggtccctgagactctcctgcgcagcctctggattctcctttagtagttatgccatgacttgggtccgccaggcctccgaggggaaggggcgtggaggtgggtctcgaggcagttggtggtagtggtgcccgaggacacatttaacgtaaacgtccctgcgagggccgtatttctttatctccagagactaattccaaggaacatactgtattcngcagttgaaccagactagagagtcgagacgacggcgttaatattagtgtagttaagtgggatgggtgctacgtcgttcggttacggggccggtacccgtggtcctaccggtntccg

SEQ ID NO: 170357 - DNA, 412 bp, Homo sapiens
  misc_feature: GYAE6OF02HXS6S.47.77.G11.1.454.CMB.1.raw
  modified_base (406)..(412): a, c, t, g, unknown or other
  misc_feature (406)..(412): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaacctggtcaccgtctcttcagcttccaccaagggcccatcggtcttccccctggcgccctgctccaggagcacctcgtggggcacagcggcctgggctgcctggtcaaggactacttcctacgtgagctctgagcgggctggcaggcgcatagnnnnnnn

SEQ ID NO: 170358 - DNA, 564 bp, Homo sapiens
  misc_feature: GYAE6OF02FUX8H.47.77.G11.1.454.CMB.1.raw
  modified_base (304)..(304): a, c, t, g, unknown or other
  misc_feature (304)..(304): n is a, c, g, or t
  modified_base (405)..(405): a, c, t, g, unknown or other
  misc_feature (405)..(405): n is a, c, g, or t
  modified_base (558)..(558): a, c, t, g, unknown or other
  misc_feature (558)..(558): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagcctggggggtccctgagactctcctgcgcagcctctggattctcctttagtagttatgccatgacttgggtcccnccaggctccgaggggaagggctgggagtgggtctcgaggcagttggtggtagtggtgccgaggacacattaacgtaaagtccctgcagggccattctttanctaccagagacaatccagaacatactgattctgctagtgacagactgagagcgaggacacggcctatattagttgtagttaagtgggattgggtgtacctaacggtcgttacggttcgggggacccgggtaacccgttgggtcctacccggtnttccgg

SEQ ID NO: 170359 - DNA, 416 bp, Homo sapiens
  misc_feature: GYAE6OF02HV45T.47.77.G11.1.454.CMB.1.raw
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (410)..(416): a, c, t, g, unknown or other
  misc_feature (410)..(416): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttagatgggatggtggctacgactcgttggggccgggaaccctggtcaccgtctcttcagcttccaccaagggccccatcggtcttccccctggccnccctgctccaggagcacctccgagngcacagcggccctgggctgcctggtcaaggctacttcctatgtatactctgagcgggctggcaaggcgcatagnnnnnnn

SEQ ID NO: 170360 - DNA, 415 bp, Homo sapiens
  misc_feature: GYAE6OF02GZZQQ.47.77.G11.1.454.CMB.1.raw
  modified_base (410)..(415): a, c, t, g, unknown or other
  misc_feature (410)..(415): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattcttcagttgaccagactgagagtcgaggacacggccgtatattattgtgttaaatgggatggtggctacgactcttggggccggggaaccctggtcaccgtctcttcagcttccaccaagggcccatcggtcttccccctggccgccctgctccaggagccacctctgggggcacagcggcctgggctgcctggtcaaggactacttcctacgtgagctctgagcgggctggcaaggcgcatagnnnnnn

SEQ ID NO: 170361 - DNA, 566 bp, Homo sapiens
  misc_feature: GYAE6OF02IIYOE.47.77.G11.1.454.CMB.1.raw
  modified_base (544)..(566): a, c, t, g, unknown or other
  misc_feature (544)..(566): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagataactcaccatggagtttgggctgacctggctttttcttgtggcttattttaaaaagtgtccagtgtgaggtgcagctggtggagtctgggggaggcttagttcagccgtggggagtccctgagactctcctgtgtagtctctggaatcagttttcagttaccttctggattgctacgtggggtcccgccaaaactccacgccctccaccgaacgggcccagtccggtccttccccccgtggcccgcccctgccctccgaggacgccacccgtccgagacgcacgacggccggcccgtcggggccttcggcccgttcgggtaccgaaacgggtaccttaaccgtttcccgtaacggttcggacgtccttccgtggacgggcggggtccttggggaccaagggccgaccgagtacggnnnnnnnnnnnnnnnnnnnnnnn

SEQ ID NO: 170362 - DNA, 417 bp, Homo sapiens
  misc_feature: GYAE6OF02HG719.47.77.G11.1.454.CMB.1.raw
  modified_base (409)..(417): a, c, t, g, unknown or other
  misc_feature (409)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttgggggccggggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaggcgcatagnnnnnnnnn

SEQ ID NO: 170363 - DNA, 845 bp, Homo sapiens
  misc_feature: GYAE6OF02FG834.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtcggggggtccctgagactctcctgcgcagcctctggacttctcctttagttagttatgccctatcggtacttcggggtcccgccgacggccttaccggaaggggtaaagggggtccgtaggggtaacggtcggggttccttaccggaagggtcctaagtttcggggttacggttaggttggggtcggcccgaagggaaccaacgtaacgttttaaaccggtaaaacggttccccgttagggaccgtaacgggggtaccctacgttttacctttttaacgttccctacccgtaaggaaaccgtaacctaaacgtttaccccgaaaagggtaaaccctaagttaaccgttaggttaacttttccgtaggaccctagggtttaccgaacccgtaagtacccgtagggaacggtaacggttaccgggaaacgggtacccgtaaccgggtacccggtttaatttaacgtttttaagttttcgggtaaggttttaaaacgggttggggggtaactttcggggggttaccgtacgtttaacccgggtactttaccgggggttacccgggggggaccccggggttaaaccccgttggggttacccttaaccccggg

SEQ ID NO: 170364 - DNA, 589 bp, Homo sapiens
  misc_feature: GYAE6OF02GVBJI.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtggggggtccctgagactctcctgcgcagcctctggattctcctttagtagttatgccatgacttgggtccgccaggctccgaggggaaggggcgtgggaggtgggtctcgaggcagttgggtggtaggtgggtcgccgaggacacagtttacgtaaacgtcccctgcgagggccgtattctttatctccagagacaattccaggaacatactgattctgcagttgaccaagactaggagtagtacggaggaccacggaccgttaatacttagttgtagtttaaagtgggtattgggtgtacgtacgtacgttcggttacgggggacccgggtaaccctgggtacctacccgg

SEQ ID NO: 170365 - DNA, 418 bp, Homo sapiens
  misc_feature: GYAE6OF02F3U44.47.77.G11.1.454.CMB.1.raw
  modified_base (410)..(418): a, c, t, g, unknown or other
  misc_feature (410)..(418): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaaccctggtcaccgtctcttcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnnnnnn

SEQ ID NO: 170366 - DNA, 424 bp, Homo sapiens
  misc_feature: GYAE6OF02JDSZZ.47.77.G11.1.454.CMB.1.raw
  modified_base (419)..(424): a, c, t, g, unknown or other
  misc_feature (419)..(424): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacattccaggaacatactgattctgcagttgaccagactgagagtcgaggacacggccgtatattattgtgttaaatgggatgggtggctacgactcgttggggccggggaaccctggtcaccgtctcttcagcttccaccaacgggcccatccggtcttccccctggccgccctgctccaggagcacctcgtgggggccacgagcggcccgtggggctgcctggtcaaggacttacttcctacgtgagctctgagcgggctggcagggcgcatagnnnnnn

SEQ ID NO: 170367 - DNA, 555 bp, Homo sapiens
  misc_feature: GYAE6OF02HBJ3D.47.77.G11.1.454.CMB.1.raw
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctatttaaaaagtgtccagtgtgaggtgcagctggtggagtctgggggaggcttagtacagcctggggggtccctgagactctcctgcgcagcctctggattctcctttagtagttatgccatgacttgggtccgccaggctccgaggggaaggggctgggagtgggtctcgaggcagttgggtggtagtgggtcgcaggacacattacgtaaagtccctgcaggccattcttatctcaganacaattcagacatactgatctncagtcgacagactgagagtcgagaccaggcctaatattagttgttagttaagtgggtattggggtgtacgtacgacggttccgttagggggcccggggtaacccgttgggtccgtacccgg

SEQ ID NO: 170368 - DNA, 474 bp, Homo sapiens
  misc_feature: GYAE6OF02GTCCN.47.77.G11.1.454.CMB.1.raw
  modified_base (460)..(474): a, c, t, g, unknown or other
  misc_feature (460)..(474): n is a, c, g, or t
tcagagctcacgtacacgaccggtgctcgatttagctagtcactcaagggaaaggggctggagtgggtctcagggtcattggtggtagtggtgccaggacacattacgtaaagtccctgcagggccgattctttatctccagagacaattccaggaacatactgattctgctagttgaccagactgagagtcgaggacacggccgtatattattgtgttaaatgggatggtggctacgactcgttgggggccggggaaccctggtccaccgtctcttcagcttccaccaagggcccatccggtcttccccctggccgcccctgcctccagggacgccaccctcgtggggggccacgacggccggccccgtggggcctcggcccttgggtccaaagggtacctactttcccgtacgtgacgtctcgtgacggcggggtctgggacgaagggcgcagtaggnnnnnnnnnnnnnnn

SEQ ID NO: 170369 - DNA, 447 bp, Homo sapiens
  misc_feature: GYAE6OF02I9QZ1.47.77.G11.1.454.CMB.1.raw
  modified_base (269)..(269): a, c, t, g, unknown or other
  misc_feature (269)..(269): n is a, c, g, or t
  modified_base (434)..(447): a, c, t, g, unknown or other
  misc_feature (434)..(447): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggcccgggaaccctggtcaccgtntcttcagcttccaccaagggcccatccggtcttccccctggccgccctgcctccaggacgccaccctcgtcgggggcacgacggccggcccgtgggcctgccgtggtccaaggtactaccttccgtacgtgacgctctgacggcgggctggacaggcgcagtagnnnnnnnnnnnnnn

SEQ ID NO: 170370 - DNA, 402 bp, Homo sapiens
  misc_feature: GYAE6OF02IAI9J.47.77.G11.1.454.CMB.1.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (385)..(402): a, c, t, g, unknown or other
  misc_feature (385)..(402): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtaatattatgtagttaaatgggatggtggctacgactcgtggggccgggaacctggtcacgtctctcngcttcacaggccatcgctccctggcnccngctcaggancactgtgggcacngcgcctggcngctggcaagtctacttcagtgagctctggagcggctggagaacggcgcaatagnnnnnnnnnnnnnnnnnn

SEQ ID NO: 170371 - DNA, 438 bp, Homo sapiens
  misc_feature: GYAE6OF02GCIT9.47.77.G11.1.454.CMB.1.raw
  modified_base (418)..(418): a, c, t, g, unknown or other
  misc_feature (418)..(418): n is a, c, g, or t
  modified_base (420)..(438): a, c, t, g, unknown or other
  misc_feature (420)..(438): n is a, c, g, or t
tcagagctcacgtacacgaccggtgctcgatttagctagtcactcaaggggaaagggctggagtgggtctcaggcattggtggtagtggtcgccaggacacattacgtaaagtccctgcagggccgattctttatctccagagacaattccaggaacatactgattctgcagttgaccagactgagagtcgaggacacggtcgtatattattgtgttaaaatgggatgggtggactacgactcttggggccgggaacctggtcaccgtctcttcagcttccaccaagggcccatcggtcttccccctcggcgccctgcctccgaggacgcacctctgggggcacagcgcctggcgtgcctggtcgaaggactacttccgtacgtgatactctggaagcgggctggctaggcgcatagnannnnnnnnnnnnnnnnnnn

SEQ ID NO: 170372 - DNA, 460 bp, Homo sapiens
  misc_feature: GYAE6OF02JMWC3.47.77.G11.1.454.CMB.1.raw
  modified_base (219)..(219): a, c, t, g, unknown or other
  misc_feature (219)..(219): n is a, c, g, or t
  modified_base (304)..(304): a, c, t, g, unknown or other
  misc_feature (304)..(304): n is a, c, g, or t
  modified_base (426)..(426): a, c, t, g, unknown or other
  misc_feature (426)..(426): n is a, c, g, or t
  modified_base (432)..(433): a, c, t, g, unknown or other
  misc_feature (432)..(433): n is a, c, g, or t
  modified_base (435)..(460): a, c, t, g, unknown or other
  misc_feature (435)..(460): n is a, c, g, or t
tcagagctcacgtacacgaccggtgctcgatttagctagtcactcaagggaaaggggcgtggagtgggtctcaggcattggtggtagtggtgccaggacacattacgtaaagtccctgcagggccgattctttatctcagagacaattccaggaacatactgattctgcagttgaccagactgagagtcgaggacacggccgtatattatgtgttaaangggatggtgctacgactcgttgggggccgggaaccctggtccaccgtctcttcagcttccacaagggcccatcggtccttccccnggcgccctgctccgagcgcacctcgtggggcacgacgcggcccgtggggcctgcccgtggtcaaacggtcttaccgttcctaggtcgagtcctcgtggacggtcgggctggcgaaggccganagtagnngnnnnnnnnnnnnnnnnnnnnnnnnnn

SEQ ID NO: 170373 - DNA, 566 bp, Homo sapiens
  misc_feature: GYAE6OF02GCVKZ.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacaggcctggggggtccctgagactctcctgcgcagcctctggattctcctttattagttatgccatgacttgggtccgccaggctcgagggaagggctggagtgggtctcgaggcagttgggtggtaggtggtgccaggacacattaacggtaaacgtccctgacagggcctattctttactctaccagacgacaattccgaagaacatactgtattctgcagttcgaccagactggagagtcgagacgacgcgtatattattgtagttaagtgggtattgggtgtactacggtacgtcggttcggggcccgggtaaccgtcggtaccgtacccgg

SEQ ID NO: 170374 - DNA, 644 bp, Homo sapiens
  misc_feature: GYAE6OF02F2Q5C.47.77.G11.1.454.CMB.1.raw
  modified_base (463)..(463): a, c, t, g, unknown or other
  misc_feature (463)..(463): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacgaggccgggggggtcccttaaacgtctcctgcgcagcgtctggtactttcctttcagtcaagtctggataagcgtgggtccgccaggctccgagggagtcgggccgtggaggttggggttggccgtgtcgaagagcgaagaactgagtggtgcgacatctagaatacgctgccacccgtagaaacggcagtacttccaacctatcctacaagagtatgtaacttacaaattaaatnttacgtacaattactactaaactaaagtggaatacgtcctaaaggtaaaactcggaaaggtacttaacgtagggtttattttaacttaccgtttcgttaacccgtaaggtaacggggttaacttcgggtaccggttttcgtaccggggtacgggggtacccggtaaggggtaactaacggg

SEQ ID NO: 170375 - DNA, 417 bp, Homo sapiens
  misc_feature: GYAE6OF02G9GE5.47.77.G11.1.454.CMB.1.raw
  modified_base (413)..(417): a, c, t, g, unknown or other
  misc_feature (413)..(417): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaaccctggtcaccgtctcttcagcttccaccaagggcccatcggtcttcccccctggcgcccctgctccaggagcacctctgggggcacagcggccctgggctgcctggtcaagggctacttcctacgtgagctctgagcgggctggcaagggcgcatagnnnnn

SEQ ID NO: 170376 - DNA, 751 bp, Homo sapiens
  misc_feature: GYAE6OF02JFB32.47.77.G11.1.454.CMB.1.raw
  modified_base (328)..(328): a, c, t, g, unknown or other
  misc_feature (328)..(328): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggtctattttaaaaagtgtaccagtgtgaggtgcagctggtggagtcgtgggggaggcttagtacaggccgtggggggtccctgagactctctgcgcagcctctggattctcctttagtagttatgccatgtacttggtccgccaggctccgagggaagggcgnggagtgggtctcgaggctagttggtggtagtggtcgccgaggacactagttacgtaaacgtccctagcgacgggtcctagtttctttaagtcctaccgtaagtaacgaccgtaaattcccgaaagggtaaccaacgttaacgtacgtaacgttaccgttagtacccgtaagtttccggaaaccgttaacggtaaccttaagggtaacgggaaaccggttaccgggtaaacggggtaacccgaaacccggggttacccgttaatttaaacggtttaaatttagggttaccgggttttaaaagtcggggttaagttggggttaccgggtaccgttaacccggtaacggtttccgggtttaccggggggaaccccggggtttaacccggtcgggtttacccggtaacccggttccgtttaccccgg

SEQ ID NO: 170377 - DNA, 424 bp, Homo sapiens
  misc_feature: GYAE6OF02GSDJ7.47.77.G11.1.454.CMB.1.raw
  modified_base (417)..(424): a, c, t, g, unknown or other
  misc_feature (417)..(424): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcttggggccggggaacctggtcaccgtctcttcagcttccaccaagggcccatcggtcttccccctggcgccctgctccaggacgccacctcgtgggggcacgagcggcccgtgggctgccgtggtcaaggactaccttcctacgtgagctctgagcgggctggcgaagggcgcatagnnnnnnnn

SEQ ID NO: 170378 - DNA, 423 bp, Homo sapiens
  misc_feature: GYAE6OF02FZ03O.47.77.G11.1.454.CMB.1.raw
  modified_base (296)..(296): a, c, t, g, unknown or other
  misc_feature (296)..(296): n is a, c, g, or t
  modified_base (408)..(423): a, c, t, g, unknown or other
  misc_feature (408)..(423): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaacctggtcaccgtctcttcagcttccaccaagggcccatcggtnttccccctggcgccctgctccaggagcacctctgggggcacagcggccctgggctgcctggtcaaggactacttcctacgtgagctctgagcgggctggcaaggcgcatagnnnnnnnnnnnnnnnn

SEQ ID NO: 170379 - DNA, 652 bp, Homo sapiens
  misc_feature: GYAE6OF02H1VXN.47.77.G11.1.454.CMB.1.raw
  modified_base (470)..(470): a, c, t, g, unknown or other
  misc_feature (470)..(470): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttctgtggctattttaaaaagtgtccagtgtgaggtgcagctggtggagtcgtgggggaggcttagtacagcctgggggtccctgagactctcctgcgcagcctctggattctcctttagtagttatgccatgacgttgggtccgccaggcctccgaggggaagggcgtgggagtgggtctcgaggctagttggtggtagtggtgcccgaggaccactaagtttaacgtaaacgtcccgtagcgacggggccgtattcttttactctaccgaagtacgactaaacttcgaaggtaactatactgtaatttcgngtactaggttcgaacccagacctggaacgtaggtaccgacgggacctaccgggtaccttaagttaatttagtttacggttagtttaaaggtcgggtaagttgggtacggtacttaaccggtacgttccggttacggggggccccggggtaaacccttggggtaaccctccggtttcttaccg

SEQ ID NO: 170380 - DNA, 589 bp, Homo sapiens
  misc_feature: GYAE6OF02HWXCT.47.77.G11.1.454.CMB.1.raw
  modified_base (462)..(462): a, c, t, g, unknown or other
  misc_feature (462)..(462): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtggggggtccctgagactctcctgcgcagcctctggattctccttttagtagttatgccatgacgttgggtcccgccaggcctccgaggggaacggggctggaggtgggtctcgaggcagttgggtggtagtgggtgccgaggacacagttaacgtaaacgtccctagcgagggccgtatttctttatcctcagagactaattccgaaggaacatactgtatttcngctagttcgacctagctagagagtcgagacgacggcgtaatattagttgtagttaaagtgggtattgggtcggtactacgtacgttcggttacgggggacccgggtaaccttcgggtacctacccgg

SEQ ID NO: 170381 - DNA, 670 bp, Homo sapiens
  misc_feature: GYAE6OF02FH907.47.77.G11.1.454.CMB.1.raw
  modified_base (109)..(109): a, c, t, g, unknown or other
  misc_feature (109)..(109): n is a, c, g, or t
  modified_base (211)..(211): a, c, t, g, unknown or other
  misc_feature (211)..(211): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
  modified_base (490)..(490): a, c, t, g, unknown or other
  misc_feature (490)..(490): n is a, c, g, or t
tcagagctcacgtacacgaccggtgctcgatttagctagtcactcaagggaaagggggagctctgagcgggcgtaggcccaaggcccgtcggaatttacgagtgtttcnttgtgatcagactgacagagagactcaccatggagttgggctgacctggcttttctgtggcttaattttaaaagtgtccagtgtgaggtgcagctggtaggngtcgtgggggaggtcgttaaggtacacgtcccggtggggggtcccctagacgacctctcccgtgcggcacgccctcgngtnttctcttagtattntcgcctatcgacgtggtccaccgtgcctccgaggaggngtgggngtggtacctgagctagtggtgtagtgtcgccaggacnctaagtacgtaacgtcccagtccgacggtcctagtttctttaactctacgacgtagaccgtaacttaccggacgtaacctatcggttagttaactcgttaacncgttaaccggttgaacccgtagaacccgtagttacccggaagttacggaacgtaaccggttcccgaaagtttattaacccgttaagtttcggtaaagttagttcggagttaaggcggttaaactccggtacgtttccgggtaccggggttacccgggacccgttaggttacccggttacc

SEQ ID NO: 170382 - DNA, 556 bp, Homo sapiens
  misc_feature: GYAE6OF02FHM29.47.77.G11.1.454.CMB.1.raw
  modified_base (334)..(334): a, c, t, g, unknown or other
  misc_feature (334)..(334): n is a, c, g, or t
  modified_base (414)..(414): a, c, t, g, unknown or other
  misc_feature (414)..(414): n is a, c, g, or t
  modified_base (500)..(500): a, c, t, g, unknown or other
  misc_feature (500)..(500): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttctgtggctattttaaaagtgtccagtgtgaggtgcagctggtggagtcgtgggggaggcgtgggtccagcctgggaagtcccctgagactctcctgtgcaacgtctggattcaccttcagtacctacggcatgcacgtgggtcccgcaggcctccgaggcaagggggctgggagngggtggctatttagatggtacagtaggaagtaattattacatgcagactcgtggacggggccattccactatcctcaganacaattccaaagaacacggtgtactctagacaaatgaaactagcctagaggtacgaccggaaggacgacggctggtagtattacgngtgtgaggtagtagttaggtaagttggaaccttccggacgaacttactctaacccg

SEQ ID NO: 170383 - DNA, 556 bp, Homo sapiens
  misc_feature: GYAE6OF02G6YZF.47.77.G11.1.454.CMB.1.raw
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (554)..(555): a, c, t, g, unknown or other
  misc_feature (554)..(555): n is a, c, g, or t
tcagagctcacgtacacgaccggtgctcgatttagctagtcactcaagggaaaggggctggagtgggtctcaggcattggtggtagtggtgccaaggacacattacgtaaagtccctgcagggccgattctttatctccagagacaatttccaggacatactgattctgcagttgaccagactggagagtcgaggacacggcctatattattgtgttaaatgggatggtgctacggactcgttggggccgggacctgtcaccgtctcttcagcttccaccaacggccatcggtcttcccctggcgcccgtgctccaggacgccacctcgtcggggcaacgacgccggccctaggggcctcgccgttcggtacgaacggtaccttaaccgttcccttaacgtcggacgtcttacgtcggaacggccgggtacctacgggaccgaaacgggccgtacgtaacgttacggngtagacgngngtacgcgtcgtcgagtcgcgcgacagcacnctntgngngacncnntncngtgngnangcgcgacgcncgctnctcnnc

SEQ ID NO: 170384 - DNA, 427 bp, Homo sapiens
  misc_feature: GYAE6OF02GE6ZN.47.77.G11.1.454.CMB.1.raw
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(427): a, c, t, g, unknown or other
  misc_feature (396)..(427): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttatctccagagacaattccaggaacatactgattctgcagttgaccagactgagagtcgaggacacggccgtatattattgtgttaaatgggatggtggctacgactgttggggcccgggaacctggtcacgtctcttcagcttcacaaggccatcgtctccccngcncctncncagngcacncgtgggcacngcgccgtggctgctggcaaggctacctctacgtgngctctgagcgggctggacgaagggcacatagnancngnnnnnnnnnnnnnnnnnnnnnnnnnnnnnnnn

SEQ ID NO: 170385 - DNA, 710 bp, Homo sapiens
  misc_feature: GYAE6OF02J2AMS.47.77.G11.1.454.CMB.1.raw
  modified_base (411)..(411): a, c, t, g, unknown or other
  misc_feature (411)..(411): n is a, c, g, or t
tcagagctcacgtacacgaccggtgctcgatttagctagtcactcaagggaaaggggcgtgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttggtccagcctggggggtccctcagactctcctgtgcagcctctggacttcacctttagttcctctttggattgaatttgggtccgccaggtacctccgaggggaaacggggtctgggtacggtggggtttggcaaaccgattaaaactccgaaggtatacgggaaagttcaaacgtaaaaaacccgttntcggttagggaaccttccgtaccgttgggaaaacggggtcccgtaagtttcccgaaacctcgttaccgtacccgtaagaacccggtaacaaaccggacccctaaaggaaaccttccgttacttcggtttttccaaggtactaaaacggtcgggaaccaagtcccgaggtaacgaggttaccgaaacgacgaaccggtcttagtagttactacgttgtaggttgtccttacgtgaccggtccctaccgggtcccgtacgtttggccttaggttcggggccccttagggtaccccgttcgg

SEQ ID NO: 170386 - DNA, 438 bp, Homo sapiens
  misc_feature: GYAE6OF02HA5VK.47.77.G11.1.454.CMB.1.raw
  modified_base (270)..(270): a, c, t, g, unknown or other
  misc_feature (270)..(270): n is a, c, g, or t
  modified_base (428)..(438): a, c, t, g, unknown or other
  misc_feature (428)..(438): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttgggggcccgggaaccctggtcaccgtntcttcagcttccaccaaggccatcggtacttccccctggccgccctgcctccaggacgccacctcgtgggggcacgacgccggcccgtcgggctcgccgtggtcgaacggactacttcctatgtatactctgagcggtcgtggcgaaggcgcagtagnnnnnnnnnnn

SEQ ID NO: 170387 - DNA, 580 bp, Homo sapiens
  misc_feature: GYAE6OF02GUNCG.47.77.G11.1.454.CMB.1.raw
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtgggggtccctgagactctcctgcgcagcctctggattctcctttagtagttatgccatgacgttgggtcccgccgaggctccgaggggaaggggctgggagtgggtctcgaggcagttggtggtagtggtgccgaggacacattacgtaagtcccngcagggcctattcttatctccaganactattccagaacatacngtattctgcagttcgaacctagactagagagtcggaaggaccacggtccgttaatacgttagttgtagttaaagtgggattgggtacgactacggtacgttccgggttcgggggacccgggtaacccttgggtaccgtacccgg

SEQ ID NO: 170388 - DNA, 557 bp, Homo sapiens
  misc_feature: GYAE6OF02HL2FS.47.77.G11.1.454.CMB.1.raw
  modified_base (391)..(391): a, c, t, g, unknown or other
  misc_feature (391)..(391): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttagtacagccgtggggggtccctgagactctcctgcgcagcctctggattctcctttagtagttatgccatgacttgggtcccgccaggctccgaggggaaggggctgggagtggggttggcaacgataaatccagatggaagtcaagaaaacctatgtggactctntgaagggcattcaccatctccagacgacaacgccaagaacctctctntttcngtacaaatcggacagcctagacggagtacgaagaccgacgggctaggtgttattactggtgtgtctctgaccgtcctcgggcccggtacgttcggtccgttcgtggggtacccg

SEQ ID NO: 170389 - DNA, 485 bp, Homo sapiens
  misc_feature: GYAE6OF02HZEQA.47.77.G11.1.454.CMB.1.raw
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (437)..(438): a, c, t, g, unknown or other
  misc_feature (437)..(438): n is a, c, g, or t
  modified_base (440)..(440): a, c, t, g, unknown or other
  misc_feature (440)..(440): n is a, c, g, or t
  modified_base (442)..(443): a, c, t, g, unknown or other
  misc_feature (442)..(443): n is a, c, g, or t
  modified_base (445)..(445): a, c, t, g, unknown or other
  misc_feature (445)..(445): n is a, c, g, or t
  modified_base (447)..(468): a, c, t, g, unknown or other
  misc_feature (447)..(468): n is a, c, g, or t
  modified_base (470)..(470): a, c, t, g, unknown or other
  misc_feature (470)..(470): n is a, c, g, or t
  modified_base (472)..(485): a, c, t, g, unknown or other
  misc_feature (472)..(485): n is a, c, g, or t
tcagagctcacgtacacgaccggtgctcgatttagctagtcactcaagggaaaggggcgtgggagtgggtctcaggcattggtgggtagtggtgccacggacacattacgtaaagtccctgcagggccgattctttatctccagagacaattccaggaacaatactgattctgcagttgaccagactgagtagtcgaggacgacggccgtatattattgtgttaaaatgggatggtggctacgacttcttgggggccgggaaccctggtcaccgtctcttcagctccaccaaggcccatccggtcttccccctgccncctgctcagganccacctcgtggggcacgacgccggccctgggcctgccctggtcaaagggaccttacttccgtaacgtgacgtctcgtgacggcgggctggcgaaggcgacaagtagcnngntnnanannnnnnnnnnnnnnnnnnnnnnanannnnnnnnnnnnnn

SEQ ID NO: 170390 - DNA, 665 bp, Homo sapiens
  misc_feature: GYAE6OF02JZXC6.47.77.G11.1.454.CMB.1.raw
  modified_base (384)..(384): a, c, t, g, unknown or other
  misc_feature (384)..(384): n is a, c, g, or t
  modified_base (518)..(518): a, c, t, g, unknown or other
  misc_feature (518)..(518): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
  modified_base (561)..(561): a, c, t, g, unknown or other
  misc_feature (561)..(561): n is a, c, g, or t
  modified_base (564)..(564): a, c, t, g, unknown or other
  misc_feature (564)..(564): n is a, c, g, or t
  modified_base (574)..(574): a, c, t, g, unknown or other
  misc_feature (574)..(574): n is a, c, g, or t
  modified_base (597)..(597): a, c, t, g, unknown or other
  misc_feature (597)..(597): n is a, c, g, or t
  modified_base (608)..(608): a, c, t, g, unknown or other
  misc_feature (608)..(608): n is a, c, g, or t
tcagagctcacgtacacgaccggtgctcgatttagctagtcactcaagggaaagggcgtggagtgggtcgtcaggcattggtggtagtggtgccaggacacattacgtaaagtccctgcaggccgattctttatctccagagacaattccaggaacatactgattctgcagttgaccagactgagagtcgaggacacggccgtatagtttaattggtagtttaaaacgtgggattcggtggtcttaccgacgtcgttcgggggacccggggaacccttgggtccaacccggttcttacctttcgaacggtcgtttccccaacgaacgggtccccaagttccggttccctttcccccgtggtccgccccgtcgccgtaccgacgngcccgtaccgtcgtcgggggcccacgtcggacccgggtcccgtcggggcttcgggccttacgggttccaaacgggtttacccttacgtttcccgtaacggttggaaacgtccgtacgtcggtacgggcccggtntcgggaacgacggtccgtgaacgttancgcngtacgnagcgancgngcgtcgctgngtcgtcgtcgtcgtcgtgtagtngtcgtcgtacncgtcgtagtacgtcgtctcgtcgtacgtacgtcgcgtacgtacgtacgtacgtagcg

SEQ ID NO: 170391 - DNA, 697 bp, Homo sapiens
  misc_feature: GYAE6OF02I70ZP.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtcttttcttgtggctattttaaaaagtgtccagtgtgaggtgcagctggtggagtcgtgggggaggcttagtacagccgtgggggtccctgagactctcctgcgcacgcctctggattctcctttagtagttatgccatgacttcgggtcccgcgaggcgtccgaggggaagggcgtggagtgggtcctcgagtcgagttggtggttaggtggtagccgaggacactaattaacgtaaacgtccctgacgacggggtccgtattctttatccttaccgagtaacgactaacgttccgaaaggtaactagttaaccgtgttaactttcccgagtacccgttaagttcccgaaccgttacggaaccttagggaacgtacgtaccgggaaggaacccgtaacgggtacctttagttaacgtttagtttacggttaacggtttaaaggttggggtaagtttacggggtggaaccgtttacgggaccggtttcgggtttacccggggggacccgggttaacccggttcggtacccgttaccccgg

SEQ ID NO: 170392 - DNA, 471 bp, Homo sapiens
  misc_feature: GYAE6OF02GTDEX.47.77.G11.1.454.CMB.1.raw
  modified_base (310)..(310): a, c, t, g, unknown or other
  misc_feature (310)..(310): n is a, c, g, or t
  modified_base (443)..(444): a, c, t, g, unknown or other
  misc_feature (443)..(444): n is a, c, g, or t
  modified_base (446)..(471): a, c, t, g, unknown or other
  misc_feature (446)..(471): n is a, c, g, or t
tcagagctcacgtacacgaccggtgctcgatttagctagtcactcaaggggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatgggtggctacgactcgttggggccggggaaccctggtccaccgtctcttcagcttccaccgaagggcccatcggtcttcccccnggccgccctgctccgaggacgccacctccgagacgcacaggccggccctgggcctggcctggtacaaggaccttactttccctacgtgagtcctgtggaggccggggctgggacgaacgggccgactagtagnngnnnnnnnnnnnnnnnnnnnnnnnnnn

SEQ ID NO: 170393 - DNA, 575 bp, Homo sapiens
  misc_feature: GYAE6OF02GD0KE.47.77.G11.1.454.CMB.1.raw
  modified_base (315)..(315): a, c, t, g, unknown or other
  misc_feature (315)..(315): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttagtacagccgtggggggtccctggagactctcctgcgcagcctctggattctccttttagtagttatgccatgacttgggtccgcaggcnccgagggaggggctggaggtgggtctcgaggctagttgggtggtagtgggtgccaggacacattacgtaaatccctgcagggcctattctttatctccagagacaacttccaaggaacatactgtattctgctagttgaccagactagagacgtcggaagaccgacggccgtaattattagttgttagttaaagtgggtattgggtacgacgttacgtacgttcggttggggacccggggtaccttcgggtacctaccgg

SEQ ID NO: 170394 - DNA, 664 bp, Homo sapiens
  misc_feature: GYAE6OF02HPAYJ.47.77.G11.1.454.CMB.1.raw
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (598)..(598): a, c, t, g, unknown or other
  misc_feature (598)..(598): n is a, c, g, or t
tcagagctcacgtacacgaccggtgctcgatttagctagtcactcaagggaaaggggagctctgagagagggagcccacgccctgggagttttctaggtggttttctatttggtgatcaggactgaacagagagaactcaccatggagtttgggctgacctggtctttttcttgtggcttattttaaaaagtgtccagtgtgaggtgcagctgggtggagtcgtgggggaggcttagtacagccgtggggggtccctgagactctcctgcgcagcctctggtattccttccttttagtagtttatcgcctatcgtacgtttcggggtcccgcccgtaggtccgtcccggaaggggggtaacggggggctcggggaaggttcgggggtcctacgagggctaggtttcggggtgggtaggttgggtcgacccgaagggaccaacgtagtttaaaccggtaaacgtcccctgcggaacgggccgtatttctttanccctacagaanactaactccgaaggtacaatactgtattcngtctagttanaccgngtactgacggagtacggagacgcggtactatatttagtgttattaaaggnggtagtgggtgtaccttacggcgttacggtcggggggacccgggtaaccttcgggtacctacccgg

SEQ ID NO: 170395 - DNA, 495 bp, Homo sapiens
  misc_feature: GYAE6OF02JOND7.47.77.G11.1.454.CMB.1.raw
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
  modified_base (458)..(459): a, c, t, g, unknown or other
  misc_feature (458)..(459): n is a, c, g, or t
  modified_base (461)..(465): a, c, t, g, unknown or other
  misc_feature (461)..(465): n is a, c, g, or t
  modified_base (467)..(467): a, c, t, g, unknown or other
  misc_feature (467)..(467): n is a, c, g, or t
  modified_base (469)..(495): a, c, t, g, unknown or other
  misc_feature (469)..(495): n is a, c, g, or t
tcagagctcacgtacacgaccggtgctcgatttagctagtcactcaagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggcgtatattattgtagttaaatgggatggtggactacgactcgttgggggacccgggaaccttggtcaccgttctcttcagtcttccacgaacggcccatcggtccttccccctggccgccctgccnccaggacncaccgtcgtggggcacgnggccggccgtggggctacgccgtggtaccgaaggaccttaccgttccgtacgtgacgtactcgtaggacggcgggtcgtcggacgaacgggcgtacgtaagtacgcgnngnnnnngngnnnnnnnnnnnnnnnnnnnnnnnnnnn

SEQ ID NO: 170396 - DNA, 476 bp, Homo sapiens
  misc_feature: GYAE6OF02IX9IT.47.77.G11.1.454.CMB.1.raw
  modified_base (133)..(133): a, c, t, g, unknown or other
  misc_feature (133)..(133): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (433)..(433): a, c, t, g, unknown or other
  misc_feature (433)..(433): n is a, c, g, or t
  modified_base (438)..(440): a, c, t, g, unknown or other
  misc_feature (438)..(440): n is a, c, g, or t
  modified_base (442)..(476): a, c, t, g, unknown or other
  misc_feature (442)..(476): n is a, c, g, or t
tcagagctcacgtacacgaccggtgctcgatttagctagtcactcaagggaaaggggctggagtgggtctcaggcattggtggtagtggtgccaggacacattacgtaaagtcctgcagggccgattctttanctccagagacaattccaggaacatactgattctgcagttgaccagactgagagtcgaggacacggccgtatattattgtgttaaatgggatggtgctacgactcgtggggccgggaacctggcaccgtctcttcagctccacagggccatcgtcttccccngcgccctgctccaggngcacctcgtcgggggcacgagcggccctgggctgccctggtcaagggtactacctttccgtacgtggacgtcctcgtgacggccgggtcgtcgggaccgtaacgggccgacgaagttacggcngtagnnngnnnnnnnnnnnnnnnnnnnnnnnnnnnnnnnnnnn

SEQ ID NO: 170397 - DNA, 624 bp, Homo sapiens
  misc_feature: GYAE6OF02GSWC7.47.77.G11.1.454.CMB.1.raw
  modified_base (440)..(440): a, c, t, g, unknown or other
  misc_feature (440)..(440): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaagtgtccagtgtgaggtgcagctggtggagtcgtgggggaggcttagtacagccgtggggggtccctggagactctcctgcgcagcctctggattcctcctttagtagttatgccatgtacttggggtcccgccaggcctccggaggggaacggggctgggaggtgggtctcgaggctagttgggtggtaggtgggtgccgaggacacgaagtttaacgtaaacgtcccgtgcgagggcctatttctttactctccaganactaattccgaaggaacatactgtactttctagcctagttcaccagactggagtagtacggaggaccaccgggtcgttaattagtttattggttaagttaaaggtgggtagttacgggtggtaccttacggacgtttcgggtttaccgggggaccccgggtaacccgttgggtaccctacccgg

SEQ ID NO: 170398 - DNA, 717 bp, Homo sapiens
  misc_feature: GYAE6OF02I433G.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtcttttcttgtggtctattttaaaaagtgtccagtgtgaggtgcagctggtggagtcgtgggggaggcttagtacagcccgtggggggtccctgagactctcctgcgcagcctctggattccttcctttagttagttatgccatgtacgttcgggtcccgccgacggcctaccgagggggaacggggtcgtgggaggttgggtccgtcgtaggacgtcgtttgggtgggttacggtgggtcgccgaggaactacgtaacgttaacgtaaacgtccctagcgtacgggccgtatttcgtttacgtcctacgagaacgtaactaacttccaaggaactacttacgtagtactttctcggactacggttacaaccgtacgaaccgtagacggacgttacggaagtacccgaacggtaccggttaattaatttacgtttagttaaggtttaaaacggtggggttaacgttggggttaccggtaaccgttacggtacccggttttcggggttaacccgggggtaccccgggggtaacccgtttccggggtacccttaaccccggg

SEQ ID NO: 170399 - DNA, 437 bp, Homo sapiens
  misc_feature: GYAE6OF02JAWYW.47.77.G11.1.454.CMB.1.raw
  modified_base (308)..(308): a, c, t, g, unknown or other
  misc_feature (308)..(308): n is a, c, g, or t
  modified_base (415)..(437): a, c, t, g, unknown or other
  misc_feature (415)..(437): n is a, c, g, or t
tcagagctcacgtacacgaccggtgctcgatttagctagtcactcaaggggaaaggggctggagtgggtctcaggcattggtggtagtggtgccaggacacattacgtaaagtccctgcagggccgattctttatctccagagacaattccaggaacatactgattctgcagttgaccagactgacgagtcgaggacacggccgtatattattgtgttaaatgggatggtggctacgactcgttggggcccggggacctggcaccgtctcttcagcttccaccaagggcccatcggtcttcccctgcnccctgctccagacgcaccgtcgtggggcacgacgcggcccgtggctgccgtggtcaaggtactctcctacgtgagctctgagcgggctggcgaacggcgctagtagnnnnnnnnnnnnnnnnnnnnnnn

SEQ ID NO: 170400 - DNA, 451 bp, Homo sapiens
  misc_feature: GYAE6OF02IS8D8.47.77.G11.1.454.CMB.1.raw
  modified_base (306)..(306): a, c, t, g, unknown or other
  misc_feature (306)..(306): n is a, c, g, or t
  modified_base (430)..(431): a, c, t, g, unknown or other
  misc_feature (430)..(431): n is a, c, g, or t
  modified_base (433)..(451): a, c, t, g, unknown or other
  misc_feature (433)..(451): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttgggggccggggaaccctggtcaccgtctcttcagctccacaggccatcggtcttcccctggccnccctgctccgaggacgcacctcgtcgggggcacgaggccggcccgtggggctgcctggtcaaggcctacttccgtacgtgagtcctcgtggagccgggctgggacgaacgggcgacgtataggnngnnnnnnnnnnnnnnnnnnn

SEQ ID NO: 170401 - DNA, 582 bp, Homo sapiens
  misc_feature: GYAE6OF02H76NU.47.77.G11.1.454.CMB.1.raw
  modified_base (451)..(451): a, c, t, g, unknown or other
  misc_feature (451)..(451): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggcttaattttaaaaagtgtccagtgtgaggtgcagctggtggagtcgtgggggagcttagtacagccgtgggggtccctgagactctcctgcgcagcctcgtggattcttcctttagtagttatgccatgtacttgggtcccgcaggctccgaggggagggctgggagtgggtctcgaggctagttggtggtaggtggtgccgaggacactattaacgtaacgtccctgcgaggcctatttctttatctcagagactacttcgaggactatactgactttcngctagttcgaccagactgagtacgtcggagacgacggcgttaattagttagtttgttagttaagtgggtattgggtacggtctacggtcgttcggtcgggggtaccccgggtaacgttcggtcctacccgg

SEQ ID NO: 170402 - DNA, 510 bp, Homo sapiens
  misc_feature: GYAE6OF02GT06N.47.77.G11.1.454.CMB.1.raw
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (479)..(510): a, c, t, g, unknown or other
  misc_feature (479)..(510): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgagacacggcgtatattattgtagttaaatgggatgggtggctacgacttcgttcgggggacccgggaacctggtccaccgtctcttcagcttccaccaggccatccgtcttccccnggccncctgctccgaggcgccaccgtcggnggggccacgacggccggcccgtgggcctgcccgtggtcccgaaagggtaccttaccgtttccgtacggtacggtacgtcccttacggttcggacggggccggggtacgtacggggacgaaacggggccgtaccgagttaggcnnnnnnnnnnnnnnnnnnnnnnnnnnnnnnnn

SEQ ID NO: 170403 - DNA, 626 bp, Homo sapiens
  misc_feature: GYAE6OF02I0YA8.47.77.G11.1.454.CMB.1.raw
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggcttatttaaaaagtgtccagtgtgaggtgcaactgttggagtcgtgggggagacttagtaccaccctggggggtccctgagactctcctgtgcacgcctctggactcacctttagcaactctgtcagtggctgggtccgccgaggccgtccgggggaagggctgggaggtcgggtctcgaagttnttgatgagagtggtagaagcanacttcgtacgtggaactccggtaggaacgggccgttacgaccatcccgtaccaggaagacctaagtttacgaaggacgcacgctgtactactaanaatanaacacgctaggaagacgacccgaaggacccgaacgggtccgtattagttccgtaggtacgaacgtaaagttcgtaagtacgtaccggtaacgttacccgcccccgttaaggcccggtacccttaaccgtttccggttaccgttacccgg

SEQ ID NO: 170404 - DNA, 590 bp, Homo sapiens
  misc_feature: GYAE6OF02GFAWN.47.77.G11.1.454.CMB.1.raw
  modified_base (470)..(470): a, c, t, g, unknown or other
  misc_feature (470)..(470): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtctgggggaggcttagtacagccgtggggggtccctgagactctcctgcgcagcctctggattctcctttagtagttatgccatgacttgggtccgccgaggctccgagggaagggctgggagtgggtctcgaggcagttgggtggtacggtgggtgacccgagggaccacgtagttaacgtaaacgtccctgccgagggcctattcgtttatccgtaccagtacgaactaacttccgaggaacctagtactgtattcngtactagttcgaccagactagagtacgtcgagacgacggccgtaatacttagtgttagttaagtgggattgggtgactacgtactcggttaggggacccgggtaaccgtggtcctaccgg

SEQ ID NO: 170405 - DNA, 764 bp, Homo sapiens
  misc_feature: GYAE6OF02HANA9.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtggggggtccctggacgactctcctgcgcagcctctggattcttcctttagtagttatgccatcgtacgtttcggggtcccgcccgagggtcctccggaagggggaacgggggccgtaggggagggttcggggtccgtacgacgggtcgtaaggtttggggttgggttaggtggggtcgtccgagggaacctaacgtaacgtttaaccggtaaaaccgttcccctagggaccggaacggggtccgttaacttttccttttacgttcccttacccgaaggtaacgtaactaaacgtttccgaaaggtaaacctattaacctaggtactttccgtagcttacgttacgaaccaggtactaggagtacggtacggaagggaccgtaacgggtaccttaattacgtttagttagtttaaggtttaaacggtgggggtaacgttagggtacggtaccgtttaccgggtacggtttccggggttaccggggggtaaccccgggggttaaccgttccgggtaccccgttacccgg

SEQ ID NO: 170406 - DNA, 655 bp, Homo sapiens
  misc_feature: GYAE6OF02GODBB.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaagtgtccagtgtgaggtgcagctggtggagtcgtgggggaggcttagtacagccgtgggggtccctgagactctcctgcgcagcctctggattctcctttagtagttatgccatgtacttgggtcccgccaggcctccgaggggaaggggctgggagtgggtctcgaggctagttgggtggtagtggtgccgaggacacattaacgtaaacgtccctgcgagggccgtatttcgtttatcctaccgaagacgactaagttccaaggaacaactactgtacttctgactagttgaaccagactaggacgtagtacggacggtaacaccgggtaccgttaatacgtttaagtttggtttaacggtttaaaaggtcggggtaagttggggtacggtaaccgttaaccggtaaccgtttccgggtttaccgggggggacccccggggttaaacccgttcggggttacccgtaaccccgg

SEQ ID NO: 170407 - DNA, 657 bp, Homo sapiens
  misc_feature: GYAE6OF02INN2V.47.77.G11.1.454.CMB.1.raw
  modified_base (432)..(432): a, c, t, g, unknown or other
  misc_feature (432)..(432): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagctggtggagtcgtgggggaggcttagtacagccgtggggggtccctggacgactcctcctgccgcacgcctctggattccttcctttagtagttatgcctatgtacgttgggtcccgtccgacggtcctccggaaggggaacggggccgtgggtaggttcgggtctcgaggtctagttgggtggtaggtgggtcgcgaggtaccatacgttaacgaaacgttcccgngtacggacgggtccgtatttcctttactcctacgagtacgaactaacttaccaaggaaactactagtagtactttcgtagacgtacgttacgaccaacggctacggacgtagtacggacggaccgacggtaccttaattagtttacgttagtaagttaaaggtgggtaatgggtacgtcgtacgtacgttcgggtacggggaccggtaccgttgggtcctaccgg

SEQ ID NO: 170408 - DNA, 576 bp, Homo sapiens
  misc_feature: GYAE6OF02F8AT5.47.77.G11.1.454.CMB.1.raw
  modified_base (489)..(489): a, c, t, g, unknown or other
  misc_feature (489)..(489): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagccgtggggggtccctgagactctcctgcgcagcctctggattctcctttagtagttatgccatgacttgggtccgccaggctccgagggaaggggctgggagtgggtctcgaggctagttgggtggtagtgggtgccgaggacactagttacgtaaacgtccctgacgagggcctatttctttatcctccagacgactaattccgaaggaacatactgtattctgctagttcgacctagactgagtagcgaggacncggactatattatgtagttaagtgggtaatgggtcgacgttacgacgttcggttacgggggacccgggaaccgttggtcctacccgg

SEQ ID NO: 170409 - DNA, 458 bp, Homo sapiens
  misc_feature: GYAE6OF02G6OCE.47.77.G11.1.454.CMB.1.raw
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
  modified_base (418)..(458): a, c, t, g, unknown or other
  misc_feature (418)..(458): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtgctacgactcttgggggccgggaaccctggtcaccgtctcttcagcttccaccaaggcccatcggtcttcccccnggcgccctgctccaggagcaccctcgtgggggcacgacgcggccctgggctgcctggtcaaggctacttcctagngagctctgacgcgggctggacaacgggcgcaacgtgagcnnnnnnnnnnnnnnnnnnnnnnnnnnnnnnnnnnnnnnnnn

SEQ ID NO: 170410 - DNA, 816 bp, Homo sapiens
  misc_feature: GYAE6OF02JV781.47.77.G11.1.454.CMB.1.raw
  modified_base (475)..(475): a, c, t, g, unknown or other
  misc_feature (475)..(475): n is a, c, g, or t
  modified_base (610)..(610): a, c, t, g, unknown or other
  misc_feature (610)..(610): n is a, c, g, or t
tcagagctcacgtacacgaccggtgctcgatttagctagtcactcaagggaaaggggagctctgagagaggagcccagccctgggatttctaggtgtttctatttggtgatcaggactgaacagagagaactcaccatggagttgggctgacctggcttttcttgtggctatttaaaagtgtccagtgtgaggtgcagcgtggtggagtcgtgggggaggtcgtagtacgaggtccgtaggggggtccctggacgactccttccgtgaccgtacgtacgcccgttacgtcggtacgttccttaccgtttacgttaacggttatcgtaccgtatcggtacggttccgggtccgtccgacggtccgtacccggaagggggtaacggggtcgtagggtcgggtgggtccgtcgaacgggtcgaggttggtggtaggtcggtgtaccgaggtacacggtagttaaccgtaaccgtccgnggtacggacgggtaccgtagttacccttagtaccctacgtacgtaaacgaaccgttaacctaccggtaaaactaccgtaaacttcgttaggtaaacttttacggacgtacggtaaagttccggaaacccggttanaccggttaacgggtacgtaacggggttcggaaaccgggttaaccgggacccggtttaaacggttatttaaaccgttagttttagggttaacgtttaaacgggtggggttaacttcgggggtaaccggtacccgtttagggtacccggtttccggggttaaccggggggaacccccggtttacccgggtacggttacccgttcccgg

SEQ ID NO: 170411 - DNA, 731 bp, Homo sapiens
  misc_feature: GYAE6OF02JFHRI.47.77.G11.1.454.CMB.1.raw
  modified_base (263)..(263): a, c, t, g, unknown or other
  misc_feature (263)..(263): n is a, c, g, or t
  modified_base (473)..(473): a, c, t, g, unknown or other
  misc_feature (473)..(473): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggcttttcttgtggctattttaaaaagtgtccagtgtgaggtgcagctggtggagtcgtgggggaggcttagtacagccgtgggggtccctgagactctcctgcgccngcctcgtggattcctccgtttagtagttatgcctagtgtacttcgggtcccgccgaggtcctaccggaggggaacggggctagggaggttggggtcctacgagggtcctaagttgggtagggtagttgggtcggacccgtaagggaccacgtaacgtttaaacggtaaacgttcccgtaggcggaaggggtccgtaatttccgttttaancccgttccgaaggtaactaacgtaaacttcccgaaagggaactaacgttcgtagttagttacccgttaggacctaggtttaccacctaagggaccttagaacgggtcgttacggaacgggtacaccgggtaccgttaattacggtttaattcgggttaaaggttaacgtgggggtaattcgggggttagtacccgttaaggttacggttaccgggtttcggggggaaccccggggtaccttaggtcccgttaacccgg

SEQ ID NO: 170412 - DNA, 451 bp, Homo sapiens
  misc_feature: GYAE6OF02HF9F7.47.77.G11.1.454.CMB.1.raw
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (416)..(451): a, c, t, g, unknown or other
  misc_feature (416)..(451): n is a, c, g, or t
tcagagctcacgtacacgaccggtgctcgatttagctagtcactccagggaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggactacgactcgttgggggcccgggaacctggtcaccgtctcttcagctccaccaagggccatcggtcttcccccngcgccctgctccaggagcacctcgtggggcacagcgcctggcngctggtcaaggactacttcctagtgagtctctgacggcgggcgtggacgaacggcgacgataaggacgnnnnnnnnnnnnnnnnnnnnnnnnnnnnnnnnnnnn

SEQ ID NO: 170413 - DNA, 703 bp, Homo sapiens
  misc_feature: GYAE6OF02HC3PE.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagctggtggagtcgtgggggaggcttagtacagccgtcggggggtccctggacgactcctcctggccgcacgcctcgtggtacttcttccgttttagtagttatgcctatgtacgttcgggtcccgccgacggcctaccgaagggggaacggggtccgtgggagggttcgggtcgtacgaggtcgtagttgggtgggtaggttgggtcggaccgaggaaccgtaactaagtttaaccggttaaacgttcccctaggaccggtacggggtccgttactttacgttttactccgtaccgaagtaacgtaacctaacgttaccgaacggtaaactactaactgttactttcgcggtctacgttacgaccagtactaggacgagtcggaacggaccgtaaccggcttaagttaagttagttaggttaagttaaaggtcgggtatagggtacgacgtacgtacgttcgggttacgggggccccgggtaacctcgggtacctcccg

SEQ ID NO: 170414 - DNA, 416 bp, Homo sapiens
  misc_feature: GYAE6OF02HONX9.47.77.G11.1.454.CMB.1.raw
  modified_base (302)..(302): a, c, t, g, unknown or other
  misc_feature (302)..(302): n is a, c, g, or t
  modified_base (406)..(416): a, c, t, g, unknown or other
  misc_feature (406)..(416): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttggggccgggaacctggtcaccgtctcttcagcttccacaaggccatcgtctcccctgcncctgctcagcgcactcgtgggcacagcggcctggctgccgtggtcaacggtactacttcctacggtgagtctctgacggcgggctgggacgaaggcgacatggnnnnnnnnnnn

SEQ ID NO: 170415 - DNA, 474 bp, Homo sapiens
  misc_feature: GYAE6OF02HTFZV.47.77.G11.1.454.CMB.1.raw
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
  modified_base (436)..(474): a, c, t, g, unknown or other
  misc_feature (436)..(474): n is a, c, g, or t
tcagagctcacgtacacgaccggtgctcgatttagctagtcactcaaggggaaagggggctggagtgggtctcaggcattggtggtagtggtgccaggacacattacgtaaagtccctgcagggccgatttctttatctccagagacaattccaggaacatactgattctgcagttgaccagactgagagtcgaggacacggcgtatattattgtgtttaaatgggatggtggctacgacttcgtggggccgggaacctggtcaccgtntcttcancttccacgacggccatcgtccttccccnggccncctgcctcaggacncaccgtcgnggggcacgacggccggcctgggctcgcctggtacaacggtactaccttcgtacgtgacgctcgtggaggcgggactcgggacaacgggcgacagtagnagcagnnnnnnnnnnnnnnnnnnnnnnnnnnnnnnnnnnnnnnn

SEQ ID NO: 170416 - DNA, 865 bp, Homo sapiens
  misc_feature: GYAE6OF02G34IE.47.77.G11.1.454.CMB.1.raw
tcagagctcacgtacacgaccggtgctcgatttagctagtcactcaagggaaagggctgagagaggagcccagccctgggattttcaggtgttttcatttggtgatcaggactgaacagagagaactcaccatggagtttggctgacctggctttttctgtgctatttaaaagtgtcagtgtgaggtgcagctggtcggagtcgtgggggagtcttaggtacaggtccgtggggggtccctgagtactctcctgacgcacgcctcgtggactttcgttacccttttaggtaacgtttatcgtcctaagttcggtaaccgttcggggtcccgtacccgtaagggtcccgttaccccggaagggggtaaacgggggtcccgttacgggggtaacggtttcgggggttaccgttaccggtaggggtaccgttaagggtttcggggttaggggtttaacggttggggttaccgtacccggaagggtacctaacgttacgtttaaacggtaaacggtccccttaggccgtaaacggggtcccgttagtttaccttttacgtccgtacccgtaggtaaaccggacctttaacggttaacccgaacggttaaacctacttaacgtacgtacttttcgacggtacgttacggttacgtaacgtacggtaaacgtggaaagttaccgtaccgggtaaggtaaccgtaccggggtaaccctttagttaaaccgttagttttaacgggtattttaaacggggtcggtaacggtttgggttacgggtaacccgtttacggtacccgtttcggggtttaccgggggacccgggttaaccccgggtttacggtccgttaccccgggttccctttaccgg

SEQ ID NO: 170417 - DNA, 658 bp, Homo sapiens
  misc_feature: GYAE6OF02GQNKC.47.77.G11.1.454.CMB.1.raw
  modified_base (271)..(271): a, c, t, g, unknown or other
  misc_feature (271)..(271): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagttgggctgacctggctttttctgtggctattttaaaaagtgtccagtgtgaggtgcagctggtggagtcgtgggggaggtcttagtacagccggtggggggtccctgagactctcctgcgcagcctcgnggtattctctttagtagttatcgtccatgacgttcgggtccgccaggcctccgaggggaaggggcgtagggaggtcgggtctcgaggctaggttggtggttacggtgggtcgaccgaggaccaacgtagtttaacgtaaacgtccctaggccgacgggccgtattctttatcctacgagacaacgtatccgaaggaactacttagtggtactttcgtcgtactacgttcgacctaagtacctagggtagtaacgggtacggaacgggaaccacgggtaccggtaattacgtttattcgggttaagttaaggtggggtaattggggtgtaccgtacggtaacgttccggtcggggggaccccggtaaccgttcgggtccgttacccgg

SEQ ID NO: 170418 - DNA, 551 bp, Homo sapiens
  misc_feature: GYAE6OF02IECK0.47.77.G11.1.454.CMB.1.raw
  modified_base (506)..(510): a, c, t, g, unknown or other
  misc_feature (506)..(510): n is a, c, g, or t
  modified_base (514)..(516): a, c, t, g, unknown or other
  misc_feature (514)..(516): n is a, c, g, or t
  modified_base (518)..(520): a, c, t, g, unknown or other
  misc_feature (518)..(520): n is a, c, g, or t
  modified_base (522)..(536): a, c, t, g, unknown or other
  misc_feature (522)..(536): n is a, c, g, or t
  modified_base (538)..(551): a, c, t, g, unknown or other
  misc_feature (538)..(551): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattcttttatctccagagacaattccaggaacatactgattctgcagttgaccagactgagagtcgaggacacggccgtatattattgtagtttaaaagtgggatgggtgctacgacttcgttggggccgggaaccctggcaccgtctcttcagccttaccgaaccgtaacgggccctagttcccggtccttccccccgtggccctccccgtgtccctaccgtaacggacgcctacccggttcgtagggggccacgaggcccggcccgtggggcctcgggaccgttcggtaacgaacggtaccttaccgtttccacggttaggacgttccgtgtaggacggccgggtactacgggactaggggacctaacgaagtacgtcnnnnnagcnnngnnnannnnnnnnnnnnnnngnnnnnnnnnnnnnn

SEQ ID NO: 170419 - DNA, 489 bp, Homo sapiens
  misc_feature: GYAE6OF02FQFC1.47.77.G11.1.454.CMB.1.raw
  modified_base (284)..(284): a, c, t, g, unknown or other
  misc_feature (284)..(284): n is a, c, g, or t
  modified_base (338)..(338): a, c, t, g, unknown or other
  misc_feature (338)..(338): n is a, c, g, or t
  modified_base (441)..(441): a, c, t, g, unknown or other
  misc_feature (441)..(441): n is a, c, g, or t
  modified_base (447)..(451): a, c, t, g, unknown or other
  misc_feature (447)..(451): n is a, c, g, or t
  modified_base (453)..(489): a, c, t, g, unknown or other
  misc_feature (453)..(489): n is a, c, g, or t
tcagagctcacgtacacgaccggtgctcgatttagctagtcactcaaggggaaaggggctggagtgggtctcaggcattggtggtagtggtgccaggacacattacgtaaagtccctgcagggccgattctttatctccagagacaattccaggtaacatactgatttctgcagttgaccagactgagagtcgaggacacgggccggtatagttattgtgtttaaaagtggggattggtggctacggacttcgttgggggcccggggaaccctgggtcaccgtntccttcagcttccaccaagggccatcggtcttccccctggcgcctgctccaggncacgtcgtggggcacgagcggcctgggctgaccctggtcgaaggcttaccttaccgtacgtgaggctacgtggacgcgggtctggctaacggcgacagtacgntacgannnnnannnnnnnnnnnnnnnnnnnnnnnnnnnnnnnnnnnnn

SEQ ID NO: 170420 - DNA, 686 bp, Homo sapiens
  misc_feature: GYAE6OF02JIFWD.47.77.G11.1.454.CMB.1.raw
  modified_base (187)..(187): a, c, t, g, unknown or other
  misc_feature (187)..(187): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
tcagagctcacgtacacgaccggtgctcgatttagctagtcactcaagggaaagggggctctgagagaggagcccagccctgggattttcaggtgttttcatttggtgatcaggactgaaccgagagaactcaccagtggagtttgggctgagctggcttctttcttgtggcttattttaaaaagtntcagtgtgaggtgcagctggtggagtcgtgggggagtcttagacagccgtgggggtccngagactctctgcncagcctctggtattctctttagtagttagtcncctatgtacgtttcgggcccgacgtaggcctaccggaaggggtaacgggtcgtagggtaggtcgggtctcggtacggctaagttgggtaggttagtcgggtcgaccgtaggactacgtaacgttaacgtaacgtcccgtaggaccgacggtacccgtagttttccttaacgtaccgtacccgaaaggacgttaaacgtaacgttcccgaaaggtaaacacgtttaccgtgtactttacgcgtacgtacgttcaaccgagtacgtagacgtaagtcgacgctaccggtagtagttagttagtttagtacggttaaaggtcggttaacgtggtaaggtcctaaacgggtcctttaggggtacccgggggaaccggttactacgggttcctaacccgg

SEQ ID NO: 170421 - DNA, 669 bp, Homo sapiens
  misc_feature: GYAE6OF02GI8J3.47.77.G11.1.454.CMB.1.raw
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggctattttaaaaagtgtccagtgtgaggtgcagcgtggtggagtcgtgggggaggcttagtacagccgtgggggtccctgagactctcctgcgcagcctctggattctcctttagtagttatgcctatgacgttcgggccgccgacggctccgaggggaacggggctgggagtgggctcgaggntagtggtgtagtggngcgaggacacagttacgtaacgtcccngcgagggcctattcgttatccgtcgaagacgtactaacttcaacggtaaacactacgtagttattcctacgactagttacgaaccgagtaccgaggtacgacggttccgaagggtaccgaaccggtccgttaaagtaactttagtttagggttaagtttaaaacgggtgggtaacggtttcggggtacggtaaccgtttaaccggtaccgttacggggtttaccgggggggacccccgggttaaacccggttcgggttaccccgtaaccccgg

SEQ ID NO: 170422 - DNA, 672 bp, Homo sapiens
  misc_feature: GYAE6OF02H5AVN.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaaagtgtcagtgtgaggtgcagcgtggtggagtcgtgggggaggtcttagtacagccgtgggggtccctggagactctcctgcgcacgcctctggtattccttcctttagtagttatggccattgacgttgggtaccccgccagggtccgtaccggaggggaacggggggtcctggggtacggttcgggttctcgtagggctagttgggtgggttagtgggtgccgtaaggaccactaagttaaaccggttaaacgtccccttgacgaggggcccgtatttcctttatccgtaccagaagtaacctaagttaccgaaggtaaacctataacctagtatttctggacttagtaccgaccacgacgttaggaaggtagtacggaaccggaacgaccggaccgttaagtatttagttagtagttaagtgggtaattgggtcgtacgtacgttcgtacggttccgggggaccggtacccgtacggtacctccgg

SEQ ID NO: 170423 - DNA, 714 bp, Homo sapiens
  misc_feature: GYAE6OF02FODVV.47.77.G11.1.454.CMB.1.raw
  modified_base (307)..(307): a, c, t, g, unknown or other
  misc_feature (307)..(307): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggaggcttagtacagcctggggggtccctgacgactctcctgcgcacgcctcgtggattctcctttagtagttatgccatgacgttgggtccnccgaggctccgaggggaacggggctggaggtgggtctcgaggtctagttggtggtagtgggtgccgaggacactatttaacgtaaaacgtccctagaccgacgggtccgtatttccgttttaatccttaccgaggaacgtaactaaacgttcccgaaagggaaacctaacgttaacctaggtactttaccgtcgtaccgtaacggtttacgaacccgtaaggtacgttaagggaaggtaacggtaccggaaagggtaacccgaaccgggtaaccgttaaagttaaacgtttaagttacggttaagtttaaaggtcggggtaagttggggtcgtacgttaaccggacgttccgggttacgggggtaccccggggtaacccgttgggtacccttaccggtccgttaccg

SEQ ID NO: 170424 - DNA, 466 bp, Homo sapiens
  misc_feature: GYAE6OF02HD5T2.47.77.G11.1.454.CMB.1.raw
  modified_base (275)..(275): a, c, t, g, unknown or other
  misc_feature (275)..(275): n is a, c, g, or t
  modified_base (441)..(442): a, c, t, g, unknown or other
  misc_feature (441)..(442): n is a, c, g, or t
  modified_base (444)..(466): a, c, t, g, unknown or other
  misc_feature (444)..(466): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctactactcgttgggggccgggaaccctggtcaccgttctcttcngcttccaccaagggcccatcggtcttccccctggcgccctgctccgaggacgcacctcgtgggggcacgagccggccgtggggcctcggcctggtacaacggtacctacgtttcctacgtgagtcctcgtcgaggccggggctgggacgtaacgggcgcagttagnngnnnnnnnnnnnnnnnnnnnnnnn

SEQ ID NO: 170425 - DNA, 589 bp, Homo sapiens
  misc_feature: GYAE6OF02I6K4X.47.77.G11.1.454.CMB.1.raw
  modified_base (394)..(394): a, c, t, g, unknown or other
  misc_feature (394)..(394): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctaattttaaaagtgtccagtgtgaggtgcagcgtgggtggaggtcgtggggggaggtcttaggtacagccgtcgggggtccctgagactctcctgcgcgagcctgtggattcctcctttagcaactctagtcatgggcgtgggtcccgccgacgggccgtccgggggaaggggtcgtggggaggtgggtcgtacgaagttatggatgaagaagtggtagaagcactnttcgtagtggactccgtaggacgggtccgttcacntcgaccagacgactatgaggnacgacgctagtactctaacaaatgaacagctagacgacgacggacgacgacgtacgtattacttcgtgtacgagtaacgttcgtactaacggtcgacgtcccggtacccgtcgcgtacctacgtttccgtagttaccgg

SEQ ID NO: 170426 - DNA, 730 bp, Homo sapiens
  misc_feature: GYAE6OF02JU0RL.47.77.G11.1.454.CMB.1.raw
  modified_base (272)..(272): a, c, t, g, unknown or other
  misc_feature (272)..(272): n is a, c, g, or t
  modified_base (336)..(336): a, c, t, g, unknown or other
  misc_feature (336)..(336): n is a, c, g, or t
  modified_base (481)..(481): a, c, t, g, unknown or other
  misc_feature (481)..(481): n is a, c, g, or t
tcagagctcacgtacacgaccggtgctcgatttagctagtcactcaagggaaaggggtctgagagaggagcccagccctgggattttcaggtgttttcatttggtgatcaggactgaaccgagagaactcacatggagtttgggctgagctggctctttctgtggtctttttaaaaggtgtccagttgtgaggtgacgtaactggttggagttcgtagggggagacgttagtaccgtacccggtcgggggtccctgacgactcgtcctggtncacgcctctcgactcctacctttagccaacgttctacgtctagtcgggtccgttcggggtcccncgaccggtcggtcccgggggaagggccgtagggtaggttcgggtcttacggaagttagttagacgtggaagagttagggtaggaagtccgattacgttcgtaaggtcgtaaccgtcgtagggtaccggtcccggttacacccgtntcccgacgtagaaccgacttacgttacggagacgccgtacgtactagtacttaaccgtaataaacgacgtaactaaagtccgtaagggtacgacgggaccgtaaccgaaccggttacggtaccgttagtttacgtttacgtacgggttagaaccgttagttacgtaacgtacggtacgtaccggtacccgtccccgtaagtcccgtaacttccggttttaccgtttaacgttacggttcccggtacggg

SEQ ID NO: 170427 - DNA, 655 bp, Homo sapiens
  misc_feature: GYAE6OF02GXXLN.47.77.G11.1.454.CMB.1.raw
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaagtgtccagtgtgaggtgcagctggtggagtcgtgggggaggcttagtacagccgtgggggtccctggacgactctccgtgcgcacgcctcnggtattccttcctttagtagttatgccatgacttgggtcccncgaggctccgaggggacgggctggagtgggctcgaggtcagttggtggtagtggtgcgagacactagtaacgtaaacgtccctaggccgggacgtactttacgtttctactcccgtagaacgactaacgttaccacgaaccgtaataccgtagtactttactcgactagttacacgtacgacgtatacggaacggttcgaacgggacgtacccggtcgtaaacgtttattactttagggttagtttaaggtaacgggttgtaggttcgggacttaacggttacgttcggtaccgggggtacccgggaacccggttccgggttaccgacccgtttaccg

SEQ ID NO: 170428 - DNA, 876 bp, Homo sapiens
  misc_feature: GYAE6OF02JRGMZ.47.77.G11.1.454.CMB.1.raw
tcagagctcacgtacacgaccggtgctcgatttagctagtcactcaagggaaaggggagctctgagagaggagcccagccctgggattttcaggtgtttcatttggtgatcaggactgaacagagagaactcaccatggagtttgggctgacctggtctttttcgtgtggtcttaattttaaaagtgtcctagtgtgaggtgctagcgtggtaggaggtcggtggggggaggtcgttaggtaaccgcggtcccgggtcgggggggtccctaggacgtaccgtcctccgtggccgccacgccctcgtggtcttccttaccgttttaggtactttatcggtacctagtcgtacggttcggggtccccgaccggtacggtccgtacccggagggggtaacgggtcggtacggggtaggtcggggttcctacgggacggtccggttaaggttcgggggttaggttaggttggggtacggtaccgaggtaacctacgttaacggtttaaaccggtaaaccggttcccgtagggtaccgggtaaccggggtaccggttacgttttaccgtttacccggtaccctaacccgggtaaggtaaaccggtaaccttaaacggttacccgtaaacggaaccttaacgtaacccggttgttaacttcgtacgaccgttagggttacctaaccgaggtaacccgttacgggaaggttccgggaacggtaaccgggaccgtacgggtacccgtttaagttacgttttaggttaccgggtttaaagtacgggttacgggtaggttcgggtaacggttacccgtaagggttacccggttcggggggtaccggggttaaccccgggtaccttacggggtcccgttaacccggg
